(12) United States Patent
Budiman et al.

(10) Patent No.: US 7,960,112 B2
(45) Date of Patent: Jun. 14, 2011

(54) GENE METHYLATION IN CANCER DIAGNOSIS

(75) Inventors: Muhammad A. Budiman, Manchester, MO (US); Jeffrey A. Jeddeloh, Oakville, MO (US); Rebecca Maloney, Centreville, VA (US); Yulia Korshunova, Clayton, MO (US)

(73) Assignee: Orion Genomics LLC, St. Louis, MO (US)

( * ) Notice: Subject to any disclaimer, the term of this patent is extended or adjusted under 35 U.S.C. 154(b) by 172 days.

(21) Appl. No.: 12/024,803

(22) Filed: Feb. 1, 2008

(65) Prior Publication Data

US 2009/0170088 A1 Jul. 2, 2009

Related U.S. Application Data

(60) Provisional application No. 60/899,218, filed on Feb. 2, 2007, provisional application No. 60/970,322, filed on Sep. 6, 2007, provisional application No. 61/021,840, filed on Jan. 17, 2008, provisional application No. 60/899,137, filed on Feb. 2, 2007, provisional application No. 60/968,690, filed on Aug. 29, 2007.

(51) Int. Cl.
*C12Q 1/68* (2006.01)

(52) U.S. Cl. ............................................. 435/6

(58) Field of Classification Search .................... None
See application file for complete search history.

(56) References Cited

U.S. PATENT DOCUMENTS 6,031,078 A * 2/2000 Khodadoust .................. 530/350
2007/0292866 A1* 12/2007 Wang et al. ....................... 435/6

FOREIGN PATENT DOCUMENTS

WO    WO 02/00927 A2    1/2002
WO    WO 02/18632 A2    3/2002

OTHER PUBLICATIONS

Klose (Trends in Biochemical Sciences, 2006, 31:89-97).*
Ordway et al (Carcinogenesis, Dec. 2006, 27:2409-2423).*
Tockman et al (Cancer Res., 1992, 52:2711s-2718s).*
Budiman, M.A. et al.; "Comprehensive epigenetic profiling reveals novel stage 1 ovarian cancer biomarkers"; Apr. 14, 2007, Orion Genomics, 1 page.
Korshunova, Y. et al.; "Genome-wide scan for epigenetic alterations in lung tumors reveals a novel list of powerful biomarkers"; Apr. 16, 2007, Orion Genomics, 2 pages.
Ibrahim, Ashraf E.K. et al.; "MMASS: an optimized array-based method for assessing CpG island methylation"; 2006, Nucleic Acids Research, vol. 34, No. 20, 1 page abstract.
Ivascu et al.; "DNA methylation profiling of transcription factor genes in normal lymphocyte development and lymphomas"; 2007, *International Journal of Biochemistry and Cell Biology*, vol. 39, No. 7-8, pp. 1523-1538.
Windschwendter, Martin et al.; "Methylation and silencing of the retinoic acid receptor-beta2 gene in breast cancer"; 2000, *Journal of the National Cancer Institute*, vol. 92, No. 10, pp. 826-832.

* cited by examiner

*Primary Examiner* — Laura B Goddard
(74) *Attorney, Agent, or Firm* — Kilpatrick Townsend & Stockton LLP

(57) ABSTRACT

The present invention provides DNA biomarker sequences that are differentially methylated in samples from normal individuals and individuals with cancer. The invention further provides methods of identifying differentially methylated DNA biomarker sequences and their use the detection and diagnosis of cancer.

30 Claims, No Drawings

GENE METHYLATION IN CANCER DIAGNOSIS

CROSS-REFERENCE TO RELATED PATENT APPLICATIONS

The present patent application claims benefit of priority to U.S. Provisional Patent Application No. 60/899,218, filed Feb. 2, 2007; U.S. Provisional Patent Application No. 60/970,322, filed Sep. 6, 2007; U.S. Provisional Patent Application No. 61/021,840, filed Jan. 17, 2008; U.S. Provisional Patent Application No. 60/899,137, filed Feb. 2, 2007; and U.S. Provisional Patent Application No. 60/968,690, filed Aug. 29, 2007, each of which are incorporated by reference.

BACKGROUND OF THE INVENTION

Human cancer cells typically contain somatically altered genomes, characterized by mutation, amplification, or deletion of critical genes. In addition, the DNA template from human cancer cells often displays somatic changes in DNA methylation. See, e.g., E. R. Fearon, et al, *Cell* 61:759 (1990); P. A. Jones, et al., *Cancer Res.* 46:461 (1986); R. Holliday, *Science* 238:163 (1987); A. De Bustros, et al., *Proc. Natl. Acad. Sci. USA* 85:5693 (1988); P. A. Jones, et al., *Adv. Cancer Res.* 54:1 (1990); S. B. Baylin, et al., *Cancer Cells* 3:383 (1991); M. Makos, et al., *Proc. Natl. Acad. Sci. USA* 89:1929 (1992); N. Ohtani-Fujita, et al., *Oncogene* 8:1063 (1993).

DNA methylases transfer methyl groups from the universal methyl donor S-adenosyl methionine to specific sites on the DNA. Several biological functions have been attributed to the methylated bases in DNA. The most established biological function is the protection of the DNA from digestion by cognate restriction enzymes. This restriction modification phenomenon has, so far, been observed only in bacteria.

Mammalian cells, however, possess different methylases that exclusively methylate cytosine residues on the DNA that are 5' neighbors of guanine (CpG). This methylation has been shown by several lines of evidence to play a role in gene activity, cell differentiation, tumorigenesis, X-chromosome inactivation, genomic imprinting and other major biological processes (Razin, A., H., and Riggs, R. D. eds. in *DNA Methylation Biochemistry and Biological Significance*, Springer-Verlag, N.Y., 1984).

In eukaryotic cells, methylation of cytosine residues that are immediately 5' to a guanosine, occurs predominantly in CpG poor loci (Bird, A., *Nature* 321:209 (1986)). In contrast, discrete regions of CG dinucleotides called CpG islands (CGi) remain unmethylated in normal cells, except during X-chromosome inactivation and parental specific imprinting (Li, et al., *Nature* 366:362 (1993)) where methylation of 5' regulatory regions can lead to transcriptional repression. For example, de novo methylation of the Rb gene has been demonstrated in a small fraction of retinoblastomas (Sakai, et al., *Am. J. Hum. Genet.*, 48:880 (1991)), and a more detailed analysis of the VHL gene showed aberrant methylation in a subset of sporadic renal cell carcinomas (Herman, et al., *Proc. Natl. Acad. Sci. U.S.A.*, 91:9700 (1994)). Expression of a tumor suppressor gene can also be abolished by de novo DNA methylation of a normally unmethylated 5' CpG island. See, e.g., Issa, et al., *Nature Genet.* 7:536 (1994); Merlo, et al., *Nature Med.* 1:686 (1995); Herman, et al., *Cancer Res.*, 56:722 (1996); Graff, et al., *Cancer Res.*, 55:5195 (1995); Herman, et al., *Cancer Res.* 55:4525 (1995).

Identification of the earliest genetic and epigenetic changes in tumorigenesis is a major focus in molecular cancer research. Diagnostic approaches based on identification of these changes can allow implementation of early detection strategies, tumor staging and novel therapeutic approaches targeting these early changes, leading to more effective cancer treatment. The present invention addresses these and other problems.

BRIEF SUMMARY OF THE INVENTION

The present invention provides methods for determining the methylation status of an individual. In one aspect, the methods comprise:
  obtaining a biological sample from an individual; and
  determining the methylation status of at least one cytosine within a DNA region in a sample from an individual where the DNA region is at least 90%, 91%, 92%, 93%, 94%, 95%, 96%, 97%, 98%, or 99% identical to, or comprises, a sequence selected from the group consisting of SEQ ID NO.: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485.

In a further aspect, the methods comprise determining the presence or absence of cancer, including but not limited to, bladder, breast, cervical, colon, endometrial, esophageal, head and neck, liver, lung, melanoma, ovarian, prostate, renal, and throid cancer, in an individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without cancer, wherein the comparison of the methylation status to the threshold value is predictive of the presence or absence of cancer in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without bladder cancer, wherein the comparison of the methylation status to the threshold value is predictive of the presence or absence of bladder cancer in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without breast cancer, wherein the comparison of the methylation status to the threshold value is predictive of the presence or absence of breast cancer in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without cervical cancer, wherein the comparison of the methylation status to the threshold value is predictive of the presence or absence of cervical cancer in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without colon cancer, wherein the comparison of the methylation status to the threshold value is predictive of the presence or absence of colon cancer in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without endometrial cancer, wherein the comparison of the methylation status to the threshold value is predictive of the presence or absence of endometrial cancer in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without esophageal cancer, wherein the comparison of the methylation status to the threshold value is predictive of the presence or absence of esophageal cancer in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without head and neck cancer, wherein the comparison of the methylation status to the threshold value is predictive of the presence or absence of head and neck cancer in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without liver cancer, wherein the comparison of the methylation status to the threshold value is predictive of the presence or absence of liver cancer in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without lung cancer, wherein the comparison of the methylation status to the threshold value is predictive of the presence or absence of lung cancer in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without melanoma, wherein the comparison of the methylation status to the threshold value is predictive of the presence or absence of melanoma in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without ovarian cancer, wherein the comparison of the methylation status to the threshold value is predictive of the presence or absence of ovarian cancer in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;
b) comparing the methylation status of the at least one cytosine to a threshold value for the biomarker, wherein the threshold value distinguishes between individuals with and without prostate cancer, wherein the comparison of the methylation status to the threshold value is predictive of the presence or absence of prostate cancer in the individual.

In some embodiments, the methods comprise:
a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;

b) comparing the methylation status of the at least one cytosine to a threshold value for the biomarker, wherein the threshold value distinguishes between individuals with and without renal cancer, wherein the comparison of the methylation status to the threshold value is predictive of the presence or absence of renal cancer in the individual.

In some embodiments, the methods comprise:

a) determining the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485;

b) comparing the methylation status of the at least one cytosine to a threshold value for the biomarker, wherein the threshold value distinguishes between individuals with and without thyroid cancer, wherein the comparison of the methylation status to the threshold value is predictive of the presence or absence of thyroid cancer in the individual.

With regard to the embodiments, in some embodiments, the determining step comprises determining the methylation status of at least one cytosine in the DNA region corresponding to a nucleotide in a biomarker, wherein the biomarker is at least 90%, 91%, 92%, 93%, 94%, 95%, 96%, 97%, 98%, or 99% identical to, or comprises, a sequence selected from the group consisting of SEQ ID NO: 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, and 388.

In some embodiments, the determining step comprises determining the methylation status of the DNA region corresponding to a biomarker.

The sample can be from any body fluid. In some embodiments, the sample is selected from blood serum, blood plasma, fine needle aspirate of the breast, biopsy of the breast, ductal fluid, ductal lavage, feces, urine, sputum, saliva, semen, lavages, or tissue biopsy, such as biopsy of the lung, bronchial lavage or bronchial brushings in the case of lung cancer. In some embodiments, the sample is from a tumor or polyp. In some embodiments, the sample is a biopsy from lung, kidney, liver, ovarian, head, neck, thyroid, bladder, cervical, colon, endometrial, esophageal, prostate or skin tissue. In some embodiments, the sample is from cell scrapes, washings, or resected tissues.

In some embodiments, the methylation status of at least one cytosine is compared to the methylation status of a control locus. In some embodiments, the control locus is an endogenous control. In some embodiments, the control locus is an exogenous control.

In some embodiments, the determining step comprises determining the methylation status of at least one cytosine in at least two of the DNA regions.

In a further aspect, the invention provides computer implemented methods for determining the presence or absence of cancer (including but not limited to cancers of the bladder, breast, cervix, colon, endometrium, esophagus, head and neck, liver, lung(s), ovaries, prostate, rectum, and thyroid, and melanoma) in an individual. In some embodiments, the methods comprise:

receiving, at a host computer, a methylation value representing the methylation status of at least one cytosine within a DNA region in a sample from the individual where the DNA region is at least 90%, 91%, 92%, 93%, 94%, 95%, 96%, 97%, 98%, or 99% identical to, or comprises, a sequence is selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485; and comparing, in the host computer, the methylation value to a threshold value, wherein the threshold value distinguishes between individuals with and without cancer (including but not limited to cancers of the bladder, breast, cervix, colon, endometrium, esophagus, head and neck, liver, lung(s), ovaries, prostate, rectum, and thyroid, and melanoma), wherein the comparison of the methylation value to the threshold value is predictive of the presence or absence of cancer (including but not limited to cancers of the bladder, breast, cervix, colon, endometrium, esophagus, head and neck, liver, lung(s), ovaries, prostate, rectum, and thyroid, and melanoma) in the individual.

In some embodiments, the receiving step comprises receiving at least two methylation values, the two methylation values representing the methylation status of at least one cytosine biomarkers from two different DNA regions; and the comparing step comprises comparing the methylation values to one or more threshold value(s) wherein the threshold value distinguishes between individuals with and without cancer (including but not limited to cancers of the bladder, breast, cervix, colon, endometrium, esophagus, head and neck, lung(s), ovaries, prostate, rectum, and thyroid, and melanoma), wherein the comparison of the methylation value to the threshold value is predictive of the presence or absence of cancer (including but not limited to cancers of the bladder, breast, cervix, colon, endometrium, esophagus, head and neck, liver, lung(s), ovaries, prostate, rectum, and thyroid, and melanoma) in the individual.

In another aspect, the invention provides computer program products for determining the presence or absence of cancer (including but not limited to cancers of the bladder, breast, cervix, colon, endometrium, esophagus, head and neck, liver, lung(s), ovaries, prostate, rectum, and thyroid, and melanoma) in an individual. In some embodiments, the computer readable products comprise:

a computer readable medium encoded with program code, the program code including:

program code for receiving a methylation value representing the methylation status of at least one cytosine within a DNA region in a sample from the individual where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485; and program code for comparing the methylation value to a threshold value, wherein the threshold value distinguishes between individuals with and without cancer (including but not limited to cancers of the bladder, breast, cervix, colon, endometrium, esophagus, head and neck, liver, lung(s), ovaries, prostate, rectum, and thyroid, and melanoma), wherein the comparison of the methylation value to the threshold value is predictive of the presence or absence of cancer (including but not limited to cancers of the bladder, breast, cervix, colon, endometrium, esophagus, head and neck, liver, lung(s), ovaries, prostate, rectum, and thyroid, and melanoma) in the individual.

In a further aspect, the invention provides kits for determining the methylation status of at least one biomarker. In some embodiments, the kits comprise:

a pair of polynucleotides capable of specifically amplifying at least a portion of a DNA region where the DNA region is selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485; and a methylation-dependent or methylation sensitive restriction enzyme and/or sodium bisulfite.

In some embodiments, the pair of polynucleotides are capable of specifically amplifying a biomarker selected from the group consisting of one or more of SEQ ID NOs: 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, and 388.

In some embodiments, the kits comprise at least two pairs of polynucleotides, wherein each pair is capable of specifically amplifying at least a portion of a different DNA region.

In some embodiments, the kits further comprise a detectably labeled polynucleotide probe that specifically detects the amplified biomarker in a real time amplification reaction.

In a further aspect, the invention provides kits for determining the methylation status of at least one biomarker. In some embodiments, the kits comprise:

sodium bisulfite and polynucleotides to quantify the presence of the converted methylated and or the converted unmethylated sequence of at least one cytosine from a DNA region that is selected from the group consisting of SEQ ID NOs: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485.

In a further aspect, the invention provides kits for determining the methylation status of at least one biomarker. In some embodiments, the kits comprise:

sodium bisulfite, primers and adapters for whole genome amplification, and polynucleotides to quantify the presence of the converted methylated and or the converted unmethylated sequence of at least one cytosine from a DNA region that is selected from the group consisting of SEQ ID NOs: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485.

In another aspect, the methods provide kits for determining the methylation status of at least one biomarker. In some embodiments, the kits comprise:

a methylation sensing restriction enzymes, primers and adapters for whole genome amplification, and polynucleotides to quantify the number of copies of at least a portion of a DNA region where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485.

In a further aspect, the invention provides kits for determining the methylation status of at least one biomarker. In some embodiments, the kits comprise:

a methylation sensing binding moiety and polynucleotides to quantify the number of copies of at least a portion of a DNA region where the DNA region is at least 90%, 91%, 92%, 93%, 94%, 95%, 96%, 97%, 98%, or 99% identical to, or comprises, a sequence selected from the group consisting of SEQ ID NO: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485.

DEFINITIONS

"Methylation" refers to cytosine methylation at positions C5 or N4 of cytosine, the N6 position of adenine or other types of nucleic acid methylation. In vitro amplified DNA is unmethylated because in vitro DNA amplification methods do not retain the methylation pattern of the amplification template. However, "unmethylated DNA" or "methylated DNA" can also refer to amplified DNA whose original template was methylated or methylated, respectively.

A "methylation profile" refers to a set of data representing the methylation states of one or more loci within a molecule of DNA from e.g., the genome of an individual or cells or tissues from an individual. The profile can indicate the methylation state of every base in an individual, can comprise information regarding a subset of the base pairs (e.g., the methylation state of specific restriction enzyme recognition sequence) in a genome, or can comprise information regarding regional methylation density of each locus.

"Methylation status" refers to the presence, absence and/or quantity of methylation at a particular nucleotide, or nucleotides within a portion of DNA. The methylation status of a particular DNA sequence (e.g., a DNA biomarker or DNA region as described herein) can indicate the methylation state of every base in the sequence or can indicate the methylation state of a subset of the base pairs (e.g., of cytosines or the methylation state of one or more specific restriction enzyme recognition sequences) within the sequence, or can indicate information regarding regional methylation density within the sequence without providing precise information of where in the sequence the methylation occurs. The methylation status can optionally be represented or indicated by a "methylation value." A methylation value can be generated, for example, by quantifying the amount of intact DNA present following restriction digestion with a methylation dependent restriction enzyme. In this example, if a particular sequence in the DNA is quantified using quantitative PCR, an amount of template DNA approximately equal to a mock treated control indicates the sequence is not highly methylated whereas an amount of template substantially less than occurs in the mock treated sample indicates the presence of methylated DNA at the sequence. Accordingly, a value, i.e., a methylation value, for example from the above described example, represents the methylation status and can thus be used as a quantitative indicator of methylation status. This is of particular use when it is desirable to compare the methylation status of a sequence in a sample to a threshold value.

A "methylation-dependent restriction enzyme" refers to a restriction enzyme that cleaves or digests DNA at or in proximity to a methylated recognition sequence, but does not cleave DNA at or near the same sequence when the recognition sequence is not methylated. Methylation-dependent restriction enzymes include those that cut at a methylated recognition sequence (e.g., DpnI) and enzymes that cut at a sequence near but not at the recognition sequence (e.g., McrBC). For example, McrBC's recognition sequence is 5' RmC (N40-3000) RmC 3' where "R" is a purine and "mC" is a methylated cytosine and "N40-3000" indicates the distance between the two RmC half sites for which a restriction event has been observed. McrBC generally cuts close to one half-site or the other, but cleavage positions are typically distributed over several base pairs, approximately 30 base pairs from the methylated base. McrBC sometimes cuts 3' of both half sites, sometimes 5' of both half sites, and sometimes between the two sites. Exemplary methylation-dependent restriction enzymes include, e.g., McrBC (see, e.g., U.S. Pat. No. 5,405,760), McrA, MrrA, BisI, GlaI and DpnI. One of skill in the art will appreciate that any methylation-dependent restriction enzyme, including homologs and orthologs of the restriction enzymes described herein, is also suitable for use in the present invention.

A "methylation-sensitive restriction enzyme" refers to a restriction enzyme that cleaves DNA at or in proximity to an unmethylated recognition sequence but does not cleave at or in proximity to the same sequence when the recognition sequence is methylated. Exemplary methylation-sensitive restriction enzymes are described in, e.g., McClelland et al., *Nucleic Acids Res.* 22(17):3640-59 (1994) and http://rebase.neb.com. Suitable methylation-sensitive restriction enzymes that do not cleave DNA at or near their recognition sequence when a cytosine within the recognition sequence is methylated at position $C^5$ include, e.g., Aat II, Aci I, Acd I, Age I, Alu I, Asc I, Ase I, AsiS I, Bbe I, BsaA I, BsaH I, BsiE I, BsiW I, BsrF I, BssH II, BssK I, BstB I, BstN I, BstU I, Cla I, Eae I, Eag I, Fau I, Fse I, Hha I, HinP1 I, HinC II, Hpa II, Hpy99 I, HpyCH4 IV, Kas I, Mbo I, Mlu I, MapA1 I, Msp I, Nae I, Nar I, Not I, Pml I, Pst I, Pvu I, Rsr II, Sac II, Sap I, Sau3A I, Sfl I, Sfo I, SgrA I, Sma I, SnaB I, Tsc I, Xma I, and Zra I. Suitable methylation-sensitive restriction enzymes that do not cleave DNA at or near their recognition sequence when an adenosine within the recognition sequence is methylated at position $N^6$ include, e.g., Mbo I. One of skill in the art will appreciate that any methylation-sensitive restriction enzyme, including homologs and orthologs of the restriction enzymes described herein, is also suitable for use in the present invention. One of skill in the art will further appreciate that a methylation-sensitive restriction enzyme that fails to cut in the presence of methylation of a cytosine at or near its recognition sequence may be insensitive to the presence of methylation of an adenosine at or near its recognition sequence. Likewise, a methylation-sensitive restriction enzyme that fails to cut in the presence of methylation of an adenosine at or near its recognition sequence may be insensitive to the presence of methylation of a cytosine at or near its recognition sequence. For example, Sau3AI is sensitive (i.e., fails to cut) to the presence of a methylated cytosine at or near its recognition sequence, but is insensitive (i.e., cuts) to the presence of a methylated adenosine at or near its recognition sequence. One of skill in the art will also appreciate that some methylation-sensitive restriction enzymes are blocked by methylation of bases on one or both strands of DNA encompassing of their recognition sequence, while other methylation-sensitive restriction enzymes are blocked only by methylation on both strands, but can cut if a recognition site is hemi-methylated.

A "threshold value that distinguishes between individuals with and without" a particular disease refers to a value or range of values of a particular measurement that can be used to distinguish between samples from individuals with the disease and samples without the disease. Ideally, there is a threshold value or values that absolutely distinguishes between the two groups (i.e., values from the diseased group are always on one side (e.g., higher) of the threshold value and values from the healthy, non-diseased group are on the other side (e.g., lower) of the threshold value). However, in many instances, threshold values do not absolutely distinguish between diseased and non-diseased samples (for example, when there is some overlap of values generated from diseased and non-diseased samples).

The phrase "corresponding to a nucleotide in a biomarker" refers to a nucleotide in a DNA region that aligns with the same nucleotide (e.g. a cytosine) in a biomarker sequence. Generally, as described herein, biomarker sequences are sub-sequences of (i.e., have 100% identity with) the DNA regions. Sequence comparisons can be performed using any BLAST including BLAST 2.2 algorithm with default parameters, described in Altschul et al., *Nuc. Acids Res.* 25:3389 3402 (1977) and Altschul et al., *J. Mol. Biol.* 215:403 410 (1990), respectively.

"Sensitivity" of a given biomarker refers to the percentage of tumor samples that report a DNA methylation value above a threshold value that distinguishes between tumor and non-tumor samples. The percentage is calculated as follows:

$$\text{Sensitivity} = \left[ \frac{\text{(the number of tumor samples above the threshold)}}{\text{(the total number of tumor samples tested)}} \right] \times 100$$

The equation may also be stated as follows:

$$\text{Sensitivity} = \left[ \frac{\text{(the number of true positive samples)}}{\left( \begin{array}{c} \text{(the number of true positive samples)} + \\ \text{(the number of false negative samples)} \end{array} \right)} \right] \times 100$$

where true positive is defined as a histology-confirmed tumor sample that reports a DNA methylation value above the threshold value (i.e. the range associated with disease), and false negative is defined as a histology-confirmed tumor sample that reports a DNA methylation value below the threshold value (i.e. the range associated with no disease). The value of sensitivity, therefore, reflects the probability that a DNA methylation measurement for a given biomarker obtained from a known diseased sample will be in the range of disease-associated measurements. As defined here, the clinical relevance of the calculated sensitivity value represents an estimation of the probability that a given biomarker would detect the presence of a clinical condition when applied to a patient with that condition.

"Specificity" of a given biomarker refers to the percentage of non-tumor samples that report a DNA methylation value below a threshold value that distinguishes between tumor and non-tumor samples. The percentage is calculated as follows:

$$\text{Specificity} = \left[ \frac{\text{(the number of non-tumor samples below the threshold)}}{\text{(the total number of non-tumor samples tested)}} \right] \times 100$$

The equation may also be stated as follows:

$$\text{Specificity} = \left[ \frac{\text{(the number of true negative samples)}}{\left( \begin{array}{c} \text{(the number of true negative samples)} + \\ \text{(the number of false positve samples)} \end{array} \right)} \right] \times 100$$

where true negative is defined as a histology-confirmed non-tumor sample that reports a DNA methylation value below the threshold value (i.e. the range associated with no disease), and false positive is defined as a histology-confirmed non-tumor sample that reports DNA methylation value above the threshold value (i.e. the range associated with disease). The value of specificity, therefore, reflects the probability that a DNA methylation measurement for a given biomarker obtained from a known non-diseased sample will be in the range of non-disease associated measurements. As defined here, the clinical relevance of the calculated specificity value represents an estimation of the probability that a given biomarker would detect the absence of a clinical condition when applied to a patient without that condition.

Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program uses as defaults a wordlength of 3, and expectation (E) of 10, and the BLOSUM62 scoring matrix (see Henikoff & Henikoff, Proc. Natl. Acad. Sci. USA 89:10915 (1989)) alignments (B) of 50, expectation (E) of 10, M=5, N=−4, and a comparison of both strands.

As used herein, the terms "nucleic acid," "polynucleotide" and "oligonucleotide" refer to nucleic acid regions, nucleic acid segments, primers, probes, amplicons and oligomer fragments. The terms are not limited by length and are generic to linear polymers of polydeoxyribonucleotides (containing 2-deoxy-D-ribose), polyribonucleotides (containing D-ribose), and any other N-glycoside of a purine or pyrimidine base, or modified purine or pyrimidine bases. These terms include double- and single-stranded DNA, as well as double- and single-stranded RNA.

A nucleic acid, polynucleotide or oligonucleotide can comprise, for example, phosphodiester linkages or modified linkages including, but not limited to phosphotriester, phosphoramidate, siloxane, carbonate, carboxymethylester, acetamidate, carbamate, thioether, bridged phosphoramidate, bridged methylene phosphonate, phosphorothioate, methylphosphonate, phosphorodithioate, bridged phosphorothioate or sulfone linkages, and combinations of such linkages.

A nucleic acid, polynucleotide or oligonucleotide can comprise the five biologically occurring bases (adenine, guanine, thymine, cytosine and uracil) and/or bases other than the five biologically occurring bases. For example, a polynucleotide of the invention can contain one or more modified, non-standard, or derivatized base moieties, including, but not limited to, $N^6$-methyl-adenine, $N^6$-tert-butyl-benzyl-adenine, imidazole, substituted imidazoles, 5-fluorouracil, 5-bromouracil, 5-chlorouracil, 5-iodouracil, hypoxanthine, xanthine, 4-acetylcytosine, 5-(carboxyhydroxymethyl) uracil, 5-carboxymethylaminomethyl-2-thiouridine, 5-carboxymethylaminomethyluracil, dihydrouracil, beta-D-galactosylqueosine, inosine, $N^6$-isopentenyladenine, 1-methylguanine, 1-methylinosine, 2,2-dimethylguanine, 2-methyladenine, 2-methylguanine, 3-methylcytosine, 5-methylcytosine, $N^6$-methyladenine, 7-methylguanine, 5-methylaminomethyluracil, 5-methoxyaminomethyl-2-thiouracil, beta-D mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, uracil-5-oxyacetic acidmethylester, 3-(3-amino-3-N-2-carboxypropyl)uracil, (acp3)w, 2,6-diaminopurine, and 5-propynyl pyrimidine. Other examples of modified, non-standard, or derivatized base moieties may be found in U.S. Pat. Nos. 6,001,611; 5,955,589; 5,844,106; 5,789,562; 5,750,343; 5,728,525; and 5,679,785.

Furthermore, a nucleic acid, polynucleotide or oligonucleotide can comprise one or more modified sugar moieties including, but not limited to, arabinose, 2-fluoroarabinose, xylulose, and a hexose.

DETAILED DESCRIPTION OF THE INVENTION

I. Introduction

The present invention is based, in part, on the discovery that sequences in certain DNA regions are methylated in cancer cells, but not normal cells. Specifically, the inventors have found that methylation of biomarkers within the DNA regions described herein are associated with various types of cancer.

In view of this discovery, the inventors have recognized that methods for detecting the biomarker sequences and DNA regions comprising the biomarker sequences as well as sequences adjacent to the biomarkers that contain a significant amount of CpG subsequences, methylation of the DNA regions, and/or expression of the genes regulated by the DNA regions can be used to detect cancer cells. Detecting cancer cells allows for diagnostic tests that detect disease, assess the risk of contracting disease, determining a predisposition to disease, stage disease, diagnose disease, monitor disease, and/or aid in the selection of treatment for a person with disease.

II. Methylation Biomarkers

In some embodiments, the presence or absence or quantity of methylation of the chromosomal DNA within a DNA region or portion thereof (e.g., at least one cytosine) selected from SEQ ID Nos: 389-485 is detected. Portions of the DNA regions described herein will comprise at least one potential methylation site (i.e., a cytosine) and can in some embodiments generally comprise 2, 3, 4, 5, 10, or more potential methylation sites. In some embodiments, the methylation status of all cytosines within at least 20, 50, 100, 200, 500 or more contiguous base pairs of the DNA region are determined.

Some of the DNA regions overlap with each other, indicating that methylation can be detected in a larger chromosomal region as defined by the boundaries of the overlapping sequences. For example, SEQ ID NO:402 overlaps with SEQ ID NO:403; SEQ ID NOs: 407, 408 and 409 overlap with each other; SEQ ID NO:425 overlaps with SEQ ID NO:426; SEQ ID NOs:411, 427, 428, 442, 443, 444 overlap with each other; and SEQ ID NO:429 overlaps with SEQ ID NO:445. Thus, for example, methylation can be detected for the purposes described herein to detect the methylation status of at least one cytosine in a sequence from:

either SEQ ID NO: 402 or 403;
any of SEQ ID NO:403; SEQ ID NOs: 407, 408 or 409;
either SEQ ID NO:425 or SEQ ID NO:426;
any of SEQ ID NOs:411, 427, 428, 442, 443, 444;
either SEQ ID NO:429 or SEQ ID NO:445.

In some embodiments, the methylation of more than one DNA region (or portion thereof) is detected. In some embodiments, the methylation status of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, or 97 of the DNA regions is determined.

In some embodiments of the invention, the methylation of a DNA region or portion thereof is determined and then normalized (e.g., compared) to the methylation of a control locus. Typically the control locus will have a known, relatively constant, methylation status. For example, the control sequence can be previously determined to have no, some or a high amount of methylation, thereby providing a relative constant value to control for error in detection methods, etc., unrelated to the presence or absence of cancer. In some embodiments, the control locus is endogenous, i.e., is part of the genome of the individual sampled. For example, in mammalian cells, the testes-specific histone 2B gene (hTH2B in human) gene is known to be methylated in all somatic tissues except testes. Alternatively, the control locus can be an exogenous locus, i.e., a DNA sequence spiked into the sample in a known quantity and having a known methylation status.

A DNA region comprises a nucleic acid including one or more methylation sites of interest (e.g., a cytosine, a "microarray feature," or an amplicon amplified from select primers) and flanking nucleic acid sequences (i.e., "wingspan") of up to 4 kilobases (kb) in either or both of the 3' or 5' direction from the amplicon. This range corresponds to the lengths of DNA fragments obtained by randomly fragmenting the DNA before screening for differential methylation between DNA in two or more samples (e.g. carrying out methods used to initially identify differentially methylated sequences as described in the Examples, below). In some embodiments, the wingspan of the one or more DNA regions is about 0.5 kb, 0.75 kb, 1.0 kb, 1.5 kb, 2.0 kb, 2.5 kb, 3.0 kb, 3.5 kb or 4.0 kb in both 3' and 5' directions relative to the sequence represented by the microarray feature.

The methylation sites in a DNA region can reside in non-coding transcriptional control sequences (e.g. promoters, enhancers, etc.) or in coding sequences, including introns and exons of the designated genes listed in Tables 1 and 2 and in section "SEQUENCE LISTING." In some embodiments, the methods comprise detecting the methylation status in the promoter regions (e.g., comprising the nucleic acid sequence that is about 1.0 kb, 1.5 kb, 2.0 kb, 2.5 kb, 3.0 kb, 3.5 kb or 4.0 kb 5' from the transcriptional start site through to the transcriptional start site) of one or more of the genes identified in Tables 1 and 2 and in section "SEQUENCE LISTING."

The DNA regions of the invention also include naturally occurring variants, including for example, variants occurring in different subject populations and variants arising from single nucleotide polymorphisms (SNPs). SNPs encompasses insertions and deletions of varying size and simple sequence repeats, such as dinucleotides and trinucleotide repeats. Variants include nucleic acid sequences from the same DNA region (e.g. as set forth in Tables 1 and 2 and in section "SEQUENCE LISTING") sharing at least 90%, 95%, 98%, 99% sequence identity, i.e., having one or more deletions, additions, substitutions, inverted sequences, etc., relative to the DNA regions described herein.

III. Methods for Determining Methylation

Any method for detecting DNA methylation can be used in the methods of the present invention.

In some embodiments, methods for detecting methylation include randomly shearing or randomly fragmenting the genomic DNA, cutting the DNA with a methylation-dependent or methylation-sensitive restriction enzyme and subsequently selectively identifying and/or analyzing the cut or uncut DNA. Selective identification can include, for example, separating cut and uncut DNA (e.g., by size) and quantifying a sequence of interest that was cut or, alternatively, that was not cut. See, e.g., U.S. Pat. No. 7,186,512. Alternatively, the method can encompass amplifying intact DNA after restriction enzyme digestion, thereby only amplifying DNA that was not cleaved by the restriction enzyme in the area amplified. See, e.g., U.S. patent application Ser. Nos. 10/971,986; 11/071,013; and 10/971,339. In some embodiments, amplification can be performed using primers that are gene specific. Alternatively, adaptors can be added to the ends of the randomly fragmented DNA, the DNA can be digested with a methylation-dependent or methylation-sensitive restriction enzyme, intact DNA can be amplified using primers that hybridize to the adaptor sequences. In this case, a second step can be performed to determine the presence, absence or quantity of a particular gene in an amplified pool of DNA. In some embodiments, the DNA is amplified using real-time, quantitative PCR.

In some embodiments, the methods comprise quantifying the average methylation density in a target sequence within a population of genomic DNA. In some embodiments, the method comprises contacting genomic DNA with a methylation-dependent restriction enzyme or methylation-sensitive restriction enzyme under conditions that allow for at least some copies of potential restriction enzyme cleavage sites in the locus to remain uncleaved; quantifying intact copies of the locus; and comparing the quantity of amplified product to a control value representing the quantity of methylation of control DNA, thereby quantifying the average methylation density in the locus compared to the methylation density of the control DNA.

The quantity of methylation of a locus of DNA can be determined by providing a sample of genomic DNA comprising the locus, cleaving the DNA with a restriction enzyme that is either methylation-sensitive or methylation-dependent, and then quantifying the amount of intact DNA or quantifying the amount of cut DNA at the DNA locus of interest. The amount of intact or cut DNA will depend on the initial amount of genomic DNA containing the locus, the amount of methylation in the locus, and the number (i.e., the fraction) of nucleotides in the locus that are methylated in the genomic DNA. The amount of methylation in a DNA locus can be determined by comparing the quantity of intact DNA or cut DNA to a control value representing the quantity of intact DNA or cut DNA in a similarly-treated DNA sample. The control value can represent a known or predicted number of methylated nucleotides. Alternatively, the control value can represent the quantity of intact or cut DNA from the same locus in another (e.g., normal, non-diseased) cell or a second locus.

By using at least one methylation-sensitive or methylation-dependent restriction enzyme under conditions that allow for at least some copies of potential restriction enzyme cleavage sites in the locus to remain uncleaved and subsequently quantifying the remaining intact copies and comparing the quantity to a control, average methylation density of a locus can be determined. If the methylation-sensitive restriction enzyme is contacted to copies of a DNA locus under conditions that allow for at least some copies of potential restriction enzyme cleavage sites in the locus to remain uncleaved, then the remaining intact DNA will be directly proportional to the methylation density, and thus may be compared to a control to determine the relative methylation density of the locus in the sample. Similarly, if a methylation-dependent restriction enzyme is contacted to copies of a DNA locus under conditions that allow for at least some copies of potential restriction enzyme cleavage sites in the locus to remain uncleaved, then the remaining intact DNA will be inversely proportional to the methylation density, and thus may be compared to a control to determine the relative methylation density of the locus in the sample. Such assays are disclosed in, e.g., U.S. patent application Ser. No. 10/971,986.

Kits for the above methods can include, e.g., one or more of methylation-dependent restriction enzymes, methylation-sensitive restriction enzymes, amplification (e.g., PCR) reagents, probes and/or primers.

Quantitative amplification methods (e.g., quantitative PCR or quantitative linear amplification) can be used to quantify the amount of intact DNA within a locus flanked by amplification primers following restriction digestion. Methods of quantitative amplification are disclosed in, e.g., U.S. Pat. Nos. 6,180,349; 6,033,854; and 5,972,602, as well as in, e.g., Gibson et al., *Genome Research* 6:995-1001 (1996); DeGraves, et al., *Biotechniques* 34(1):106-10, 112-5 (2003); Deiman B, et al., *Mol. Biotechnol.* 20(2):163-79 (2002). Amplifications may be monitored in "real time."

Additional methods for detecting DNA methylation can involve genomic sequencing before and after treatment of the DNA with bisulfite. See, e.g., Frommer et al., *Proc. Natl. Acad. Sci. USA* 89:1827-1831 (1992). When sodium bisulfite is contacted to DNA, unmethylated cytosine is converted to uracil, while methylated cytosine is not modified.

In some embodiments, restriction enzyme digestion of PCR products amplified from bisulfite-converted DNA is used to detect DNA methylation. See, e.g., Sadri & Hornsby, *Nucl. Acids Res.* 24:5058-5059 (1996); Xiong & Laird, *Nucleic Acids Res.* 25:2532-2534 (1997).

In some embodiments, a MethyLight assay is used alone or in combination with other methods to detect DNA methylation (see, Eads et al., *Cancer Res.* 59:2302-2306 (1999)). Briefly, in the MethyLight process genomic DNA is converted in a sodium bisulfite reaction (the bisulfite process converts unmethylated cytosine residues to uracil). Amplification of a DNA sequence of interest is then performed using PCR primers that hybridize to CpG dinucleotides. By using primers that hybridize only to sequences resulting from bisulfite conversion of unmethylated DNA, (or alternatively to methylated sequences that are not converted) amplification can indicate methylation status of sequences where the primers hybridize. Similarly, the amplification product can be detected with a probe that specifically binds to a sequence resulting from bisulfite treatment of a unmethylated (or methylated) DNA. If desired, both primers and probes can be used to detect methylation status. Thus, kits for use with MethyLight can include sodium bisulfite as well as primers or detectably-labeled probes (including but not limited to Taqman or molecular beacon probes) that distinguish between methylated and unmethylated DNA that have been treated with bisulfite. Other kit components can include, e.g., reagents necessary for amplification of DNA including but not limited to, PCR buffers, deoxynucleotides; and a thermostable polymerase.

In some embodiments, a Ms-SNuPE (Methylation-sensitive Single Nucleotide Primer Extension) reaction is used alone or in combination with other methods to detect DNA methylation (see, Gonzalgo & Jones, *Nucleic Acids Res.* 25:2529-2531 (1997)). The Ms-SNuPE technique is a quantitative method for assessing methylation differences at specific CpG sites based on bisulfite treatment of DNA, followed by single-nucleotide primer extension (Gonzalgo & Jones, supra). Briefly, genomic DNA is reacted with sodium bisulfite to convert unmethylated cytosine to uracil while leaving 5-methylcytosine unchanged. Amplification of the desired target sequence is then performed using PCR primers specific for bisulfite-converted DNA, and the resulting product is isolated and used as a template for methylation analysis at the CpG site(s) of interest.

Typical reagents (e.g., as might be found in a typical Ms-SNuPE-based kit) for Ms-SNuPE analysis can include, but are not limited to: PCR primers for specific gene (or methylation-altered DNA sequence or CpG island); optimized PCR buffers and deoxynucleotides; gel extraction kit; positive control primers; Ms-SNuPE primers for a specific gene; reaction buffer (for the Ms-SNuPE reaction); and detectably-labeled nucleotides. Additionally, bisulfite conversion reagents may include: DNA denaturation buffer; sulfonation buffer; DNA recovery regents or kit (e.g., precipitation, ultrafiltration, affinity column); desulfonation buffer; and DNA recovery components.

In some embodiments, a methylation-specific PCR ("MSP") reaction is used alone or in combination with other methods to detect DNA methylation. An MSP assay entails initial modification of DNA by sodium bisulfite, converting all unmethylated, but not methylated, cytosines to uracil, and subsequent amplification with primers specific for methylated versus unmethylated DNA. See, Herman et al., *Proc. Natl. Acad. Sci. USA* 93:9821-9826, (1996); U.S. Pat. No. 5,786,146.

Additional methylation detection methods include, but are not limited to, methylated CpG island amplification (see, Toyota et al., *Cancer Res.* 59:2307-12 (1999)) and those described in, e.g., U.S. Patent Publication 2005/0069879; Rein, et al. *Nucleic Acids Res.* 26 (10): 2255-64 (1998); Olek, et al. *Nat. Genet.* 17(3): 275-6 (1997); and PCT Publication No. WO 00/70090.

It is well known that methylation of genomic DNA can affect expression (transcription and/or translation) of nearby gene sequences. Therefore, in some embodiments, the methods include the step of correlating the methylation status of at least one cytosine in a DNA region with the expression of nearby coding sequences, as described in Tables 1 and 2 and in section "SEQUENCE LISTING." For example, expression of gene sequences within about 1.0 kb, 1.5 kb, 2.0 kb, 2.5 kb, 3.0 kb, 3.5 kb or 4.0 kb in either the 3' or 5' direction from the cytosine of interest in the DNA region can be detected. Methods for measuring transcription and/or translation of a particular gene sequence are well known in the art. See, for example, Ausubel, *Current Protocols in Molecular Biology*, 1987-2006, John Wiley & Sons; and Sambrook and Russell, *Molecular Cloning: A Laboratory Manual*, 3rd Edition, 2000, Cold Spring Harbor Laboratory Press. In some embodiments, the gene or protein expression of a gene in Tables 1 and 2 and in section "SEQUENCE LISTING" is compared to a control, for example, the methylation status in the DNA region and/or the expression of a nearby gene sequence from a sample from an individual known to be negative for cancer or known to be positive for cancer, or to an expression level that distinguishes between cancer and noncancer states. Such methods, like the methods of detecting methylation described herein, are useful in providing diagnosis, prognosis, etc., of cancer.

In some embodiments, the methods further comprise the step of correlating the methylation status and expression of one or more of the gene regions identified in Tables 1 and 2 and in section "SEQUENCE LISTING."

IV. Cancer Detection

The present biomarkers and methods can be used in the diagnosis, prognosis, classification, prediction of disease risk, detection of recurrence of disease, and selection of treatment of a number of types of cancers. A cancer at any stage of progression can be detected, such as primary, metastatic, and recurrent cancers. Information regarding numerous types of cancer can be found, e.g., from the American Cancer Society (available on the worldwide web at cancer.org), or from, e.g., *Harrison's Principles of Internal Medicine*, Kaspar, et al., eds., 16th Edition, 2005, McGraw-Hill, Inc. Exemplary cancers that can be detected include lung, breast, renal, liver, ovarian, head and neck, thyroid, bladder, cervical, colon, endometrial, esophageal, prostate cancer or melanoma.

The present invention provides methods for determining whether or not a mammal (e.g., a human) has cancer, whether or not a biological sample taken from a mammal contains cancerous cells, estimating the risk or likelihood of a mammal developing cancer, classifying cancer types and stages, monitoring the efficacy of anti-cancer treatment, or selecting the appropriate anti-cancer treatment in a mammal with cancer. Such methods are based on the discovery that cancer cells have a different methylation status than normal cells in the DNA regions described in the invention. Accordingly, by determining whether or not a cell contains differentially methylated sequences in the DNA regions as described herein, it is possible to determine whether or not the cell is cancerous.

In numerous embodiments of the present invention, the presence of methylated nucleotides in the diagnostic biomarker sequences of the invention is detected in a biological sample, thereby detecting the presence or absence of cancerous cells in the biological sample.

In some embodiments, the biological sample comprises a tissue sample from a tissue suspected of containing cancerous cells. For example, in an individual suspected of having cancer, breast tissue, lymph tissue, lung tissue, brain tissue, or blood can be evaluated. Alternatively, lung, renal, liver, ovarian, head and neck, thyroid, bladder, cervical, colon, endometrial, esophageal, prostate, or skin tissue can be evaluated. The tissue or cells can be obtained by any method known in the art including, e.g., by surgery, biopsy, phlebotomy, swab, nipple discharge, stool, etc. In other embodiments, a tissue sample known to contain cancerous cells, e.g., from a tumor, will be analyzed for the presence or quantity of methylation at one or more of the diagnostic biomarkers of the invention to determine information about the cancer, e.g., the efficacy of certain treatments, the survival expectancy of the individual, etc. In some embodiments, the methods will be used in conjunction with additional diagnostic methods, e.g., detection of other cancer biomarkers, etc.

Genomic DNA samples can be obtained by any means known in the art. In cases where a particular phenotype or disease is to be detected, DNA samples should be prepared from a tissue of interest, or as appropriate, from blood. For example, DNA can be prepared from biopsy tissue to detect the methylation state of a particular locus associated with cancer. The nucleic acid-containing specimen used for detection of methylated loci (see, e.g. Ausubel et al., *Current Protocols in Molecular Biology* (1995 supplement)) may be from any source and may be extracted by a variety of techniques such as those described by Ausubel et al., *Current Protocols in Molecular Biology* (1995) or Sambrook et al., Molecular Cloning, A Laboratory Manual (3rd ed. 2001).

The methods of the invention can be used to evaluate individuals known or suspected to have cancer or as a routine clinical test, i.e., in an individual not necessarily suspected to have cancer. Further diagnostic assays can be performed to confirm the status of cancer in the individual.

Further, the present methods may be used to assess the efficacy of a course of treatment. For example, the efficacy of an anti-cancer treatment can be assessed by monitoring DNA methylation of the biomarker sequences described herein over time in a mammal having cancer. For example, a reduction or absence of methylation in any of the diagnostic biomarkers of the invention in a biological sample taken from a mammal following a treatment, compared to a level in a sample taken from the mammal before, or earlier in, the treatment, indicates efficacious treatment.

The methods detecting cancer can comprise the detection of one or more other cancer-associated polynucleotide or polypeptides sequences. Accordingly, detection of methylation of any one or more of the diagnostic biomarkers of the invention can be used either alone, or in combination with other biomarkers, for the diagnosis or prognosis of cancer.

The methods of the present invention can be used to determine the optimal course of treatment in a mammal with cancer. For example, the presence of methylated DNA within any of the diagnostic biomarkers of the invention or an increased quantity of methylation within any of the diagnostic biomarkers of the invention can indicate a reduced survival expectancy of a mammal with cancer, thereby indicating a more aggressive treatment for the mammal. In addition, a correlation can be readily established between the presence, absence or quantity of methylation at a diagnostic biomarker, as described herein, and the relative efficacy of one or another anti-cancer agent. Such analyses can be performed, e.g., retrospectively, i.e., by detecting methylation in one or more of the diagnostic genes in samples taken previously from mammals that have subsequently undergone one or more types of anti-cancer therapy, and correlating the known efficacy of the treatment with the presence, absence or levels of methylation of one or more of the diagnostic biomarkers.

In making a diagnosis, prognosis, risk assessment, classification, detection of recurrence or selection of therapy based on the presence or absence of methylation in at least one of the diagnostic biomarkers, the quantity of methylation may be compared to a threshold value that distinguishes between one diagnosis, prognosis, risk assessment, classification, etc., and another. For example, a threshold value can represent the degree of methylation found at a particular DNA region that adequately distinguishes between cancer samples and normal samples with a desired level of sensitivity and specificity. It is understood that a threshold value will likely vary depending on the assays used to measure methylation, but it is also understood that it is a relatively simple matter to determine a threshold value or range by measuring methylation of a DNA sequence in cancer samples and normal samples using the particular desired assay and then determining a value that distinguishes at least a majority of the cancer samples from a majority of non-cancer samples. If methylation of two or more DNA regions is detected, two or more different threshold values (one for each DNA region) will often, but not always, be used. Comparisons between a quantity of methylation of a sequence in a sample and a threshold value can be performed in any way known in the art. For example, a manual comparison can be made or a computer can compare and analyze the values to detect disease, assess the risk of contracting disease, determining a predisposition to disease, stage disease, diagnose disease, monitor, or aid in the selection of treatment for a person with disease.

In some embodiments, threshold values provide at least a specified sensitivity and specificity for detection of a particular cancer type. In some embodiments, the threshold value allows for at least a 50%, 60%, 70%, or 80% sensitivity and specificity for detection of a specific cancer, e.g., breast, lung, renal, liver, ovarian, head and neck, thyroid, bladder, cervical, colon, endometrial, esophageal, prostate cancer or melanoma.

In embodiments involving prognosis of cancer (including, for example, the prediction of progression of non-malignant lesions to invasive carcinoma, prediction of metastasis, prediction of disease recurrance or prediction of a response to a particular treatment), in some embodiments, the threshold value is set such that there is at least 10, 20, 30, 40, 50, 60, 70, 80% or more sensitivity and at least 70% specificity with regard to detecting cancer.

In some embodiments, the methods comprise recording a diagnosis, prognosis, risk assessment or classification, based on the methylation status determined from an individual. Any type of recordation is contemplated, including electronic recordation, e.g., by a computer.

V. Kits

This invention also provides kits for the detection and/or quantification of the diagnostic biomarkers of the invention, or expression or methylation thereof using the methods described herein.

For kits for detection of methylation, the kits of the invention can comprise at least one polynucleotide that hybridizes to at least one of the diagnostic biomarker sequences of the invention and at least one reagent for detection of gene methylation. Reagents for detection of methylation include, e.g., sodium bisulfite, polynucleotides designed to hybridize to sequence that is the product of a biomarker sequence of the invention if the biomarker sequence is not methylated (e.g., containing at least one C→U conversion), and/or a methylation-sensitive or methylation-dependent restriction enzyme. The kits can provide solid supports in the form of an assay apparatus that is adapted to use in the assay. The kits may further comprise detectable labels, optionally linked to a polynucleotide, e.g., a probe, in the kit. Other materials useful in the performance of the assays can also be included in the kits, including test tubes, transfer pipettes, and the like. The kits can also include written instructions for the use of one or more of these reagents in any of the assays described herein.

In some embodiments, the kits of the invention comprise one or more (e.g., 1, 2, 3, 4, or more) different polynucleotides (e.g., primers and/or probes) capable of specifically amplifying at least a portion of a DNA region where the DNA region is a sequence selected from the group consisting of SEQ ID NOs: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485. Optionally, one or more detectably-labeled polypeptide capable of hybridizing to the amplified portion can also be included in the kit. In some embodiments, the kits comprise sufficient primers to amplify 2, 3, 4, 5, 6, 7, 8, 9, 10, or more different DNA regions or portions thereof, and optionally include detectably-labeled polynucleotides capable of hybridizing to each amplified DNA region or portion thereof. The kits further can comprise a methylation-dependent or methylation sensitive restriction enzyme and/or sodium bisulfite.

In some embodiments, the kits comprise sodium bisulfite, primers and adapters (e.g., oligonucleotides that can be ligated or otherwise linked to genomic fragments) for whole genome amplification, and polynucleotides (e.g., detectably-labeled polynucleotides) to quantify the presence of the converted methylated and or the converted unmethylated sequence of at least one cytosine from a DNA region that is selected from the group consisting of SEQ ID NOs: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485.

In some embodiments, the kits comprise a methylation sensing restriction enzymes (e.g., a methylation-dependent restriction enzyme and/or a methylation-sensitive restriction enzyme), primers and adapters for whole genome amplification, and polynucleotides to quantify the number of copies of at least a portion of a DNA region where the DNA region is selected from the group consisting of SEQ ID NOs: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485.

In some embodiments, the kits comprise a methylation binding moiety and one or more polynucleotides to quantify the number of copies of at least a portion of a DNA region where the DNA region is selected from the group consisting of SEQ ID NOs: 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485. A methylation binding moiety refers to a molecule (e.g., a polypeptide) that specifically binds to methyl-cytosine. Examples include restriction enzymes or fragments thereof that lack DNA cutting activity but retain the ability to bind methylated DNA, antibodies that specifically bind to methylated DNA, etc.).

VI. Computer-Based Methods

The calculations for the methods described herein can involve computer-based calculations and tools. For example, a methylation value for a DNA region or portion thereof can be compared by a computer to a threshold value, as described herein. The tools are advantageously provided in the form of computer programs that are executable by a general purpose computer system (referred to herein as a "host computer") of conventional design. The host computer may be configured with many different hardware components and can be made in many dimensions and styles (e.g., desktop PC, laptop, tablet PC, handheld computer, server, workstation, mainframe). Standard components, such as monitors, keyboards, disk drives, CD and/or DVD drives, and the like, may be included. Where the host computer is attached to a network, the connections may be provided via any suitable transport media (e.g., wired, optical, and/or wireless media) and any suitable communication protocol (e.g., TCP/IP); the host computer may include suitable networking hardware (e.g., modem, Ethernet card, WiFi card). The host computer may implement any of a variety of operating systems, including UNIX, Linux, Microsoft Windows, MacOS, or any other operating system.

Computer code for implementing aspects of the present invention may be written in a variety of languages, including PERL, C, C++, Java, JavaScript, VBScript, AWK, or any other scripting or programming language that can be executed on the host computer or that can be compiled to execute on the host computer. Code may also be written or distributed in low level languages such as assembler languages or machine languages.

The host computer system advantageously provides an interface via which the user controls operation of the tools. In the examples described herein, software tools are implemented as scripts (e.g., using PERL), execution of which can be initiated by a user from a standard command line interface of an operating system such as Linux or UNIX. Those skilled in the art will appreciate that commands can be adapted to the operating system as appropriate. In other embodiments, a graphical user interface may be provided, allowing the user to control operations using a pointing device. Thus, the present invention is not limited to any particular user interface.

Scripts or programs incorporating various features of the present invention may be encoded on various computer readable media for storage and/or transmission. Examples of suitable media include magnetic disk or tape, optical storage media such as compact disk (CD) or DVD (digital versatile disk), flash memory, and carrier signals adapted for transmission via wired, optical, and/or wireless networks conforming to a variety of protocols, including the Internet.

EXAMPLES

Example 1

Identification of Cancer DNA Methylation Biomarkers

Loci that are differentially methylated in tumors relative to matched adjacent histologically normal tissue were identified using a DNA microarray-based technology platform that utilizes the methylation-dependent restriction enzyme McrBC. See, e.g. U.S. Pat. No. 7,186,512. In the discovery phase, cancer tissue and normal tissue samples were analyzed. Purified genomic DNA from each sample (60 µg) was randomly sheared to a range of 1 to 4 kb. The sheared DNA of each sample was then split into four equal portions of 15 µg each. Two portions were digested with McrBC under the following conditions: 15 µg sheared genomic DNA, 1×NEB2 buffer (New England Biolabs), 0.1 mg/mL bovine serum albumin (New England Biolabs), 2 mM GTP (Roche) and 120 units of McrBC enzyme (New England Biolabs) in a total volume of 600 µL at 37° C. for approximately 12 hours. These two portions represent a technical replicate of McrBC digestion (Treated 1 and Treated 2). The remaining two 15 µg portions were mock treated under identical conditions with the exception that 12 µL of sterile 50% glycerol were added instead of McrBC enzyme. These two portions represent a technical replicate of mock treatment (Untreated 1 and Untreated 2). All reactions were treated with 5 µL proteinase K (50 mg/mL) for 1 hour at 50° C., and precipitated with EtOH under standard conditions. Pellets were washed twice with 70% EtOH, dried and resuspended in 30 µL H2O, Samples were then resolved on a 1% low melting point SeaPlaque GTG Agarose gel (Cambridge Bio Sciences). Untreated 1 and Treated 1 portions were resolved side-by-side, as were Untreated 2 and Treated 2 portions. 1 kb DNA sizing ladder was resolved adjacent to each untreated/treated pair to guide accurate gel slice excision. Gels were visualized with long-wave UV, and gel slices including DNA within the modal size range of the untreated fraction (approximately 1-4 kb) were excised with a clean razor blade. DNA was extracted from gel slices using gel extraction kits (Qiagen).

McrBC recognizes a pair of methylated cytosine residues in the context 5'-Pu$^m$C (N$_{40-2000}$) Pu$^m$C-3' (where Pu=A or G, $^m$C=5-methylcytosine, and N=any nucleotide), and cleaves within approximately 30 base-pairs from one of the methylated cytosine residues. Therefore, loci that include high local densities of Pu $^m$C will be cleaved to a greater extent than loci that include low local densities of Pu $^m$C. Since Untreated and Treated portions were resolved by agarose gel electrophoresis, and DNA within the modal size range of the Untreated portions were excised and gel extracted, the Untreated portions represent the entire fragmented genome of the sample while the Treated portions are depleted of DNA fragments including Pu $^m$C. Fractions were analyzed using a duplicated dye swap microarray hybridization paradigm. For example, equal mass (200 ng) of Untreated 1 and Treated 1 fraction DNA were used as template for labeling with Cy3 and Cy5, repectively, and hybridized to a microarray (described below). Equal mass (200 ng) of the same Untreated 1 and Treated 1 fraction DNA were used as template for labeling with Cy5 and Cy3, respectively, and hybridized to a second microarray (these two hybridizations represent a dye swap of Untreated 1/Treated 1 fractions). Equal mass (200 ng) of Untreated 2 and Treated 2 fraction DNA were used as template for labeling with Cy3 and Cy5, respectively, and hybridized to a third microarray. Finally, equal mass (200 ng) of Untreated 2 and Treated 2 fraction DNA were used as template for labeling with Cy5 and Cy3, respectively, and hybridized to a fourth microarray (the final two hybridizations represent a technical replicate of the first dye swap). All DNA samples (e.g., tumor samples and adjacent normal samples) were analyzed in this way.

The microarray described in this Example consists of 380,727 features. Each 50mer oligonucleotide feature is represented by three replicates per microarray slide, yielding a total of 124,877 unique feature probes, and 2412 control probes. Each probe was selected to represent a 1 Kb interval of the human genome. Because of the natural intersection of epigenetically interesting loci (i.e. promoters, CpG Islands, etc) there are multiple probes per genomic interval providing the capacity of supporting measurements with adjacent feature's data. The genomic content represented by the features represents the majority of ENSEMBL recognized human transcriptional start sites (TSS) with two probes per TSS (>55,000 probes). In addition there are more than 35,000 probes designed to informatically identified CpG Islands (see, Takai and Jones, Proc Natl. Acad. Sci. U.S.A. 99(6): 3740-3745 (2002)). In addition, more than 7000 probes are dedicated to tiling consensus cancer genes at 1 probe kb of genomic sequence. There are high, low and middle repetitious copy number controls (HERV, line and sine) and the design included tiles of the mitochondrial genome and a consensus rDNA gene.

Following statistical analysis of these datasets, loci that were predicted to be differentially methylated in at least 70% of tumors relative to normal tissues were identified. As described in the Examples below, differential DNA methylation of a collection of loci identified by a microarray discovery experiment was verified within the discovery panel of tumor and normal samples, as well as validated in larger panels of independent cancer tissue DNA, normal DNA tissue samples, and normal peripheral blood samples. Tables 1 and 2 and the section "SEQUENCE LISTING" list the unique microarray feature identifier (Feature name) for each of these loci.

The genomic region in which a given microarray feature can report DNA methylation status is dependent upon the molecular size of the DNA fragments that were labeled for the microarray hybridizations. As described above, DNA in the size range of 1 to 4 kb was purified by agarose gel extraction and used as template for cyanogen dye labeling. Therefore, a conservative estimate for the genomic region interrogated by each microarray feature is 1 kb (i.e., 500 bp upstream and 500 bp downstream of the sequence represented by the microarray feature). Note that some features represent loci in which there is no Ensembl gene ID and no annotated transcribed gene within this 1 kb "wingspan" (e.g., CHR01P063154999, CHR03P027740753, CHR10P118975684, CHR11P021861414, CHR14P093230340, ha1p__12601__150, ha1p__42350__150, and ha1p__44897__150) and some features have Ensembl gene IDs but no gene description (e.g., CHR01P043164342, CHR01P225608458, CHR02P223364582, CHR03P052525960, CHR16P000373719, CHR19P018622408). Also note that some features represent loci in which more than one Ensembl gene IDs within wingspan (e.g., CHR01P204123050, CHR02P223364582, and CHR16P066389027). DNA methylation at these loci may potentially affect the regulation of any of these neighboring genes.

TABLE 1

Microarray Features Reporting Differential Methylation and Identity of Annotated Genes within 1 kb of Each Feature

| Locus Number | Feature Name | Ensembl Gene ID | Annotations |
|---|---|---|---|
| 1 | CHR01P001976799 | ENSG00000067606 | Protein kinase C, zeta type (EC 2.7.1.37) (nPKC-zeta). [Source: Uniprot/SWISSPROT; Acc: Q05513] |
| 2 | CHR01P026794862 | ENSG00000175793 | 14-3-3 protein sigma (Stratifin) (Epithelial cell marker protein 1). [Source: Uniprot/SWISSPROT; Acc: P31947] |
| 3 | CHR01P043164342 | ENSG00000184157 | no desc |
| 4 | CHR01P063154999 | N/A | N/A |
| 5 | CHR01P204123050 | ENSG00000162891 | Interleukin-20 precursor (IL-20) (Four alpha helix cytokine Zcyto10). [Source: Uniprot/SWISSPROT; Acc: Q9NYY1] |
| | | ENSG00000162896 | Polymeric-immunoglobulin receptor precursor (Poly-Ig receptor) (PIGR) [Contains: Secretory component]. [Source: Uniprot/SWISSPROT; Acc: P01833] |
| 6 | CHR01P206905110 | ENSG00000196878 | Laminin beta-3 chain precursor (Laminin 5 beta 3) (Laminin B1k chain) (Kalinin B1 chain). [Source: Uniprot/SWISSPROT; Acc: Q13751] |
| 7 | CHR01P225608458 | ENSG00000198504 | no desc |
| 8 | CHR02P005061785 | ENSG00000171853 | Tetratricopeptide repeat protein 15 (TPR repeat protein 15). [Source: Uniprot/SWISSPROT; Acc: Q8WVT3] |
| 9 | CHR02P042255672 | ENSG00000162878 | no desc |
| 10 | CHR02P223364582 | ENSG00000135903 | Paired box protein Pax-3 (HUP2). [Source: Uniprot/SWISSPROT; Acc: P23760] |
| | | ENSG00000163081 | no desc |
| 11 | CHR03P027740753 | N/A | N/A |
| 12 | CHR03P052525960 | ENSG00000168268 | no desc |
| 13 | CHR03P069745999 | ENSG00000187098 | Microphthalmia-associated transcription factor. [Source: Uniprot/SWISSPROT; Acc: O75030] |
| 14 | CHR05P059799713 | ENSG00000152931 | Prostate-specific and androgen regulated protein PART-1. [Source: Uniprot/SWISSPROT; Acc: Q9NPD0] |
| 15 | CHR05P059799813 | ENSG00000152931 | Prostate-specific and androgen regulated protein PART-1. [Source: Uniprot/SWISSPROT; Acc: Q9NPD0] |
| 16 | CHR05P177842690 | ENSG00000050767 | collagen, type XXIII, alpha 1 [Source: RefSeq_peptide; Acc: NP_775736] |
| 17 | CHR06P010694062 | ENSG00000111846 | N-acetyllactosaminide beta-1,6-N-acetylglucosaminyl-transferase (EC 2.4.1.150) (N-acetylglucosaminyltransferase) (I-branching enzyme) (IGNT). [Source: Uniprot/SWISSPROT; Acc: Q06430] |
| 18 | CHR06P026333318 | ENSG00000196966 | Histone H3.1 (H3/a) (H3/c) (H3/d) (H3/f) (H3/h) (H3/i) (H3/j) (H3/k) (H3/l). [Source: Uniprot/SWISSPROT; Acc: P68431] |
| 19 | CHR08P102460854 | ENSG00000083307 | transcription factor CP2-like 3 [Source: RefSeq_peptide; Acc: NP_079191] |
| 20 | CHR08P102461254 | ENSG00000083307 | transcription factor CP2-like 3 [Source: RefSeq_peptide; Acc: NP_079191] |
| 21 | CHR08P102461554 | ENSG00000083307 | transcription factor CP2-like 3 [Source: RefSeq_peptide; Acc: NP_079191] |
| 22 | CHR09P000107988 | ENSG00000184492 | Forkhead box protein D4 (Forkhead-related protein FKHL9) (Forkhead-related transcription factor 5) (FREAC-5) (Myeloid factor-alpha). [Source: Uniprot/SWISSPROT; Acc: Q12950] |
| 23 | CHR09P021958839 | ENSG00000147889 | Cyclin-dependent kinase 4 inhibitor A (CDK4I) (p16-INK4) (p16-INK4a) (Multiple tumor suppressor 1) (MTS1). [Source: Uniprot/SWISSPROT; Acc: P42771] |
| 24 | CHR09P131048752 | ENSG00000165699 | Hamartin (Tuberous sclerosis 1 protein). [Source: Uniprot/SWISSPROT; Acc: Q92574] |
| 25 | CHR10P118975684 | N/A | N/A |
| 26 | CHR11P021861414 | N/A | N/A |
| 27 | CHR12P004359362 | ENSG00000118972 | Fibroblast growth factor 23 precursor (FGF-23) (Tumor-derived hypophosphatemia-inducing factor). [Source: Uniprot/SWISSPROT; Acc: Q9GZV9] |
| 28 | CHR12P016001231 | ENSG00000023697 | Putative deoxyribose-phosphate aldolase (EC 4.1.2.4) (Phosphodeoxyriboaldolase) (Deoxyriboaldolase) (DERA). [Source: Uniprot/SWISSPROT; Acc: Q9Y315] |
| 29 | CHR14P018893344 | ENSG00000185271 | PREDICTED: similar to RIKEN cDNA C530050O22 [Source: RefSeq_peptide_predicted; Acc: XP_063481] |
| 30 | CHR14P093230340 | N/A | N/A |
| 31 | CHR16P000373719 | ENSG00000198098 | no desc |
| 32 | CHR16P066389027 | ENSG00000089505 | Chemokine-like factor (C32). [Source: Uniprot/SWISSPROT; Acc: Q9UBR5] |
| | | ENSG00000140932 | Chemokine-like factor super family member 2. [Source: Uniprot/SWISSPROT; Acc: Q8TAZ6] |
| 33 | CHR16P083319654 | ENSG00000140945 | Cadherin-13 precursor (Truncated-cadherin) (T-cadherin) (T-cad) (Heart-cadherin) (H-cadherin) (P105). [Source: Uniprot/SWISSPROT; Acc: P55290] |
| 34 | CHR18P019705147 | ENSG00000053747 | Laminin alpha-3 chain precursor (Epiligrin 170 kDa subunit) (E170) (Nicein alpha subunit). [Source: Uniprot/SWISSPROT; Acc: Q16787] |
| 35 | CHR19P018622408 | ENSG00000167487 | no desc |

TABLE 1-continued

Microarray Features Reporting Differential Methylation and Identity of Annotated Genes within 1 kb of Each Feature

| Locus Number | Feature Name | Ensembl Gene ID | Annotations |
| --- | --- | --- | --- |
| 36 | CHR19P051892823 | ENSG00000105287 | Protein kinase C, D2 type (EC 2.7.1.—) (nPKC-D2) (Protein kinase D2). [Source: Uniprot/SWISSPROT; Acc: Q9BZL6] |
| 37 | CHRXP013196410 | ENSG00000046653 | Neuronal membrane glycoprotein M6-b (M6b). [Source: Uniprot/SWISSPROT; Acc: Q13491] |
| 38 | CHRXP013196870 | ENSG00000046653 | Neuronal membrane glycoprotein M6-b (M6b). [Source: Uniprot/SWISSPROT; Acc: Q13491] |
| 39 | ha1p16__00179__l50 | ENSG00000147889 | Cyclin-dependent kinase 4 inhibitor A (CDK4I) (p16-INK4) (p16-INK4a) (Multiple tumor suppressor 1) (MTS1). [Source: Uniprot/SWISSPROT; Acc: P42771] |
| 40 | ha1p16__00182__l50 | ENSG00000147889 | Cyclin-dependent kinase 4 inhibitor A (CDK4I) (p16-INK4) (p16-INK4a) (Multiple tumor suppressor 1) (MTS1). [Source: Uniprot/SWISSPROT; Acc: P42771] |
| 41 | ha1p16__00257__l50 | ENSG00000147889 | Cyclin-dependent kinase 4 inhibitor A (CDK4I) (p16-INK4) (p16-INK4a) (Multiple tumor suppressor 1) (MTS1). [Source: Uniprot/SWISSPROT; Acc: P42771] |
| 42 | ha1p__12601__l50 | N/A | N/A |
| 43 | ha1p__17147__l50 | ENSG00000072201 | Ubiquitin ligase LNX (EC 6.3.2.—) (Numb-binding protein 1) (Ligand of Numb-protein X 1). [Source: Uniprot/SWISSPROT; Acc: Q8TBB1] |
| 44 | ha1p__42350__l50 | N/A | N/A |
| 45 | ha1p__44897__l50 | N/A | N/A |
| 46 | ha1p__61253__l50 | ENSG00000168767 | Glutathione S-transferase Mu 2 (EC 2.5.1.18) (GSTM2-2) (GST class-mu 2). [Source: Uniprot/SWISSPROT; Acc: P28161] |
| 47 | chr01p001005050 | N/A | N/A |
| 48 | chr16p001157479 | ENSG00000196557 | Voltage-dependent T-type calcium channel alpha-1H subunit (Voltage-gated calcium channel alpha subunit Cav3.2). [Source: Uniprot/SWISSPROT; Acc: O95180] |
| 49 | ha1g__00681 | ENSG00000105997 | Homeobox protein Hox-A3 (Hox-1E). [Source: Uniprot/SWISSPROT; Acc: O43365] |
| 50 | ha1g__01966 | N/A | N/A |
| 51 | ha1g__02153 | N/A | N/A |
| 52 | ha1g__02319 | ENSG00000135638 | Homeobox protein EMX1 (Empty spiracles homolog 1) (Empty spiracles-like protein 1). [Source: Uniprot/SWISSPROT; Acc: Q04741] |
| 53 | ha1g__02335 | ENSG00000106006 | Homeobox protein Hox-A6 (Hox-1B). [Source: Uniprot/SWISSPROT; Acc: P31267] |
| 54 | ha1p16__00182 | ENSG00000147889 | Cyclin-dependent kinase 4 inhibitor A (CDK4I) (p16-INK4) (p16-INK4a) (Multiple tumor suppressor 1) (MTS1). [Source: Uniprot/SWISSPROT; Acc: P42771] |
| 55 | ha1p16__00185 | ENSG00000147889 | Cyclin-dependent kinase 4 inhibitor A (CDK4I) (p16-INK4) (p16-INK4a) (Multiple tumor suppressor 1) (MTS1). [Source: Uniprot/SWISSPROT; Acc: P42771] |
| 56 | ha1p16__00193 | ENSG00000147889 | Cyclin-dependent kinase 4 inhibitor A (CDK4I) (p16-INK4) (p16-INK4a) (Multiple tumor suppressor 1) (MTS1). [Source: Uniprot/SWISSPROT; Acc: P42771] |
| 57 | ha1p16__00259 | ENSG00000147889 | Cyclin-dependent kinase 4 inhibitor A (CDK4I) (p16-INK4) (p16-INK4a) (Multiple tumor suppressor 1) (MTS1). [Source: Uniprot/SWISSPROT; Acc: P42771] |
| 58 | ha1p__02799 | N/A | N/A |
| 59 | ha1p__03567 | ENSG00000165678 | Growth hormone inducible transmembrane protein (Dermal papilla derived protein 2) (Transmembrane BAX inhibitor motif containing protein 5). [Source: Uniprot/SWISSPROT; Acc: Q9H3K2] |
| 60 | ha1p__03671 | ENSG00000158195 | Wiskott-Aldrich syndrome protein family member 2 (WASP-family protein member 2) (WAVE-2 protein) (Verprolin homology domain-containing protein 2). [Source: Uniprot/SWISSPROT; Acc: Q9Y6W5] |
| 61 | ha1p__05803 | N/A | N/A |
| 62 | ha1p__07131 | N/A | N/A |
| 63 | ha1p__07989 | ENSG00000066032 | Alpha-2 catenin (Alpha-catenin-related protein) (Alpha N-catenin). [Source: Uniprot/SWISSPROT; Acc: P26232] |
| | | ENSG00000181987 | no desc |
| 64 | ha1p__08588 | N/A | N/A |
| 65 | ha1p__09700 | ENSG00000171243 | Sclerostin domain containing protein 1 precursor (Ectodermal BMP inhibitor) (Ectodin) (Uterine sensitization-associated gene 1 protein) (USAG-1). [Source: Uniprot/SWISSPROT; Acc: Q6X4U4] |
| 66 | ha1p__104458 | N/A | N/A |
| 67 | ha1p__105287 | ENSG00000089356 | FXYD domain-containing ion transport regulator 3 precursor (Chloride conductance inducer protein Mat-8) (Mammary tumor 8 kDa protein) (Phospholemman-like). [Source: Uniprot/SWISSPROT; Acc: Q14802] |
| 68 | ha1p__10702 | ENSG00000105996 | Homeobox protein Hox-A2. [Source: Uniprot/SWISSPROT; Acc: O43364] |

TABLE 1-continued

Microarray Features Reporting Differential Methylation and Identity of Annotated Genes within 1 kb of Each Feature

| Locus Number | Feature Name | Ensembl Gene ID | Annotations |
| --- | --- | --- | --- |
| 69 | ha1p_108469 | ENSG00000099337 | Potassium channel subfamily K member 6 (Inward rectifying potassium channel protein TWIK-2) (TWIK-originated similarity sequence). [Source: Uniprot/SWISSPROT; Acc: Q9Y257] |
| 70 | ha1p_108849 | ENSG00000083844 | Zinc finger protein 264. [Source: Uniprot/SWISSPROT; Acc: O43296] |
| 71 | ha1p_11016 | ENSG00000106125 | Aquaporin-1 (AQP-1) (Aquaporin-CHIP) (Water channel protein for red blood cells and kidney proximal tubule) (Urine water channel). [Source: Uniprot/SWISSPROT; Acc: P29972] |
| 72 | ha1p_11023 | ENSG00000154978 | EGFR-coamplified and overexpressed protein [Source: RefSeq_peptide; Acc: NP_110423] |
| 73 | ha1p_12974 | ENSG00000154277 | Ubiquitin carboxyl-terminal hydrolase isozyme L1 (EC 3.4.19.12) (EC 6.—.—.—) (UCH-L1) (Ubiquitin thiolesterase L1) (Neuron cytoplasmic protein 9.5) (PGP 9.5) (PGP9.5). [Source: Uniprot/SWISSPROT; Acc: P09936] |
| 74 | ha1p_16027 | ENSG00000170178 | Homeobox protein Hox-D12 (Hox-4H). [Source: Uniprot/SWISSPROT; Acc: P35452] |
| 75 | ha1p_16066 | ENSG00000128709 | Homeobox protein Hox-D9 (Hox-4C) (Hox-5.2). [Source: Uniprot/SWISSPROT; Acc: P28356] |
| 76 | ha1p_18911 | ENSG00000115306 | Spectrin beta chain, brain 1 (Spectrin, non-erythroid beta chain 1) (Beta-II spectrin) (Fodrin beta chain). [Source: Uniprot/SWISSPROT; Acc: Q01082] |
| 77 | ha1p_19254 | ENSG00000149571 | Kin of IRRE-like protein 3 precursor (Kin of irregular chiasm-like protein 3) (Nephrin-like 2). [Source: Uniprot/SWISSPROT; Acc: Q8IZU9] |
| 78 | ha1p_19853 | ENSG00000186960 | Full-length cDNA clone CS0DF012YF04 of Fetal brain of Homo sapiens (human) (Fragment). [Source: Uniprot/SPTREMBL; Acc: Q86U37] |
| 79 | ha1p_22257 | ENSG00000001626 | Cystic fibrosis transmembrane conductance regulator (CFTR) (cAMP-dependent chloride channel). [Source: Uniprot/SWISSPROT; Acc: P13569] |
| 80 | ha1p_22519 | N/A | N/A |
| 81 | ha1p_31800 | N/A | N/A |
| 82 | ha1p_33290 | ENSG00000147408 | Chondroitin beta-1,4-N-acetylgalactosaminyltransferase 1 (EC 2.4.1.174) (beta4GalNAcT-1). [Source: Uniprot/SWISSPROT; Acc: Q8TDX6] |
| 83 | ha1p_37635 | ENSG00000066405 | Claudin-18. [Source: Uniprot/SWISSPROT; Acc: P56856] |
| 84 | ha1p_39189 | ENSG00000121853 | Growth hormone secretagogue receptor type 1 (GHS-R) (GH-releasing peptide receptor) (GHRP) (Ghrelin receptor). [Source: Uniprot/SWISSPROT; Acc: Q92847] |
| 85 | ha1p_39511 | ENSG00000164035 | Endomucin precursor (Endomucin-2) (Gastric cancer antigen Ga34). [Source: Uniprot/SWISSPROT; Acc: Q9ULC0] |
| 86 | ha1p_39752 | ENSG00000169836 | Neuromedin K receptor (NKR) (Neurokinin B receptor) (NK-3 receptor) (NK-3R) (Tachykinin receptor 3). [Source: Uniprot/SWISSPROT; Acc: P29371] |
| 87 | ha1p_60945 | ENSG00000070814 | Treacle protein (Treacher Collins syndrome protein). [Source: Uniprot/SWISSPROT; Acc: Q13428] |
| 88 | ha1p_62183 | N/A | N/A |
| 89 | ha1p_69418 | ENSG00000180667 | no desc |
| 90 | ha1p_71224 | ENSG00000113205 | Protocadherin beta 3 precursor (PCDH-beta3). [Source: Uniprot/SWISSPROT; Acc: Q9Y5E6] |
| 91 | ha1p_74221 | ENSG00000125895 | no desc |
| 92 | ha1p_76289 | ENSG00000145888 | Glycine receptor alpha-1 chain precursor (Glycine receptor 48 kDa subunit) (Strychnine binding subunit). [Source: Uniprot/SWISSPROT; Acc: P23415] |
| 93 | ha1p_81050 | ENSG00000187529 | PREDICTED: similar to 60S ribosomal protein L7 [Source: RefSeq_peptide_predicted; Acc: XP_018432] |
| 94 | ha1p_81674 | ENSG00000174197 | MGA protein (Fragment). [Source: Uniprot/SPTREMBL; Acc: Q8IWI9] |
| 95 | ha1p_86355 | ENSG00000171878 | Ferritin light chain (Fragment). [Source: Uniprot/SPTREMBL; Acc: Q6DMM8] |
| 96 | ha1p_98491 | N/A | N/A |
| 97 | ha1p_99426 | ENSG00000198028 | zinc finger protein 560 [Source: RefSeq_peptide; Acc: NP_689689] |

Example 2

Design of Independent DNA Methylation Verification and Validation Assays

PCR primers that interrogated the loci predicted to be differentially methylated between tumor and histologically normal tissue were designed. Due to the functional properties of the enzyme, DNA methylation-dependent depletion of DNA fragments by McrBC is capable of monitoring the DNA methylation status of sequences neighboring the genomic sequences represented by the features on the microarray described in Example 1 (wingspan). Since the size of DNA fragments analyzed as described in Example 1 was approximately 1-4 kb, we selected a 1 kb region spanning the sequence represented by the microarray feature as a conservative estimate of the predicted region of differential methylation. For each locus, PCR primers were selected within this approximately 1 kb region flanking the genomic sequence represented on the DNA microarray (approximately 500 bp upstream and 500 bp downstream). Selection of primer sequences was guided by uniqueness of the primer sequence across the genome, as well as the distribution of purine-CG sequences within the 1 kb region. PCR primer pairs were selected to amplify an approximately 400-600 bp sequence within each 1 kb region. Optimal PCR cycling conditions for the primer pairs were empirically determined, and amplification of a specific PCR amplicon of the correct size was verified. The sequences of the microarray features, primer pairs and amplicons are indicated in Table 2, and in section "SEQUENCE LISTING."

TABLE 2

Sequence identification numbers for all sequences described in the application. See, section "SEQUENCE LISTING" for actual sequences as listed by number in the table.

| Feature Name | Locus Number (SEQ ID NO:) | Left Primer (SEQ ID NO:) | Right Primer (SEQ ID NO:) | Annealing Temp. | Amplicon Seq. (SEQ ID NO:) | DNA Region Seq. (SEQ ID NO:) |
|---|---|---|---|---|---|---|
| CHR01P001976799 | 1 | 98 | 195 | 66 C. | 292 | 389 |
| CHR01P026794862 | 2 | 99 | 196 | 62 C. | 293 | 390 |
| CHR01P043164342 | 3 | 100 | 197 | 66 C. | 294 | 391 |
| CHR01P063154999 | 4 | 101 | 198 | 66 C. | 295 | 392 |
| CHR01P204123050 | 5 | 102 | 199 | 62 C. | 296 | 393 |
| CHR01P206905110 | 6 | 103 | 200 | 66 C. | 297 | 394 |
| CHR01P225608458 | 7 | 104 | 201 | 66 C. | 298 | 395 |
| CHR02P005061785 | 8 | 105 | 202 | 72 C. | 299 | 396 |
| CHR02P042255672 | 9 | 106 | 203 | 66 C. | 300 | 397 |
| CHR02P223364582 | 10 | 107 | 204 | 66 C. | 301 | 398 |
| CHR03P027740753 | 11 | 108 | 205 | 66 C. | 302 | 399 |
| CHR03P052525960 | 12 | 109 | 206 | 66 C. | 303 | 400 |
| CHR03P069745999 | 13 | 110 | 207 | 66 C. | 304 | 401 |
| CHR05P059799713 | 14 | 111 | 208 | 66 C. | 305 | 402 |
| CHR05P059799813 | 15 | 112 | 209 | 66 C. | 306 | 403 |
| CHR05P177842690 | 16 | 113 | 210 | 62 C. | 307 | 404 |
| CHR06P010694062 | 17 | 114 | 211 | 66 C. | 308 | 405 |
| CHR06P026333318 | 18 | 115 | 212 | 66 C. | 309 | 406 |
| CHR08P102460854 | 19 | 116 | 213 | 66 C. | 310 | 407 |
| CHR08P102461254 | 20 | 117 | 214 | 66 C. | 311 | 408 |
| CHR08P102461554 | 21 | 118 | 215 | 66 C. | 312 | 409 |
| CHR09P000107988 | 22 | 119 | 216 | 66 C. | 313 | 410 |
| CHR09P021958839 | 23 | 120 | 217 | 66 C. | 314 | 411 |
| CHR09P131048752 | 24 | 121 | 218 | 66 C. | 315 | 412 |
| CHR10P118975684 | 25 | 122 | 219 | 66 C. | 316 | 413 |
| CHR11P021861414 | 26 | 123 | 220 | 66 C. | 317 | 414 |
| CHR12P004359362 | 27 | 124 | 221 | 66 C. | 318 | 415 |
| CHR12P016001231 | 28 | 125 | 222 | 66 C. | 319 | 416 |
| CHR14P018893344 | 29 | 126 | 223 | 66 C. | 320 | 417 |
| CHR14P093230340 | 30 | 127 | 224 | 66 C. | 321 | 418 |
| CHR16P000373719 | 31 | 128 | 225 | 66 C. | 322 | 419 |
| CHR16P066389027 | 32 | 129 | 226 | 66 C. | 323 | 420 |
| CHR16P083319654 | 33 | 130 | 227 | 66 C. | 324 | 421 |
| CHR18P019705147 | 34 | 131 | 228 | 66 C. | 325 | 422 |
| CHR19P018622408 | 35 | 132 | 229 | 66 C. | 326 | 423 |
| CHR19P051892823 | 36 | 133 | 230 | 66 C. | 327 | 424 |
| CHRXP013196410 | 37 | 134 | 231 | 66 C. | 328 | 425 |
| CHRXP013196870 | 38 | 135 | 232 | 66 C. | 329 | 426 |
| ha1p16__00179_l50 | 39 | 136 | 233 | 66 C. | 330 | 427 |
| ha1p16__00182_l50 | 40 | 137 | 234 | 66 C. | 331 | 428 |
| ha1p16__00257_l50 | 41 | 138 | 235 | 66 C. | 332 | 429 |
| ha1p__12601_l50 | 42 | 139 | 236 | 66 C. | 333 | 430 |
| ha1p__17147_l50 | 43 | 140 | 237 | 66 C. | 334 | 431 |
| ha1p__42350_l50 | 44 | 141 | 238 | 66 C. | 335 | 432 |
| ha1p__44897_l50 | 45 | 142 | 239 | 66 C. | 336 | 433 |
| ha1p__61253_l50 | 46 | 143 | 240 | 72 C. | 337 | 434 |
| CHR01P001005050 | 47 | 144 | 241 | 72 C. | 338 | 435 |
| CHR16P001157479 | 48 | 145 | 242 | 72 C. | 339 | 436 |
| ha1g__00681 | 49 | 146 | 243 | 65 C. | 340 | 437 |
| ha1g__01966 | 50 | 147 | 244 | 65 C. | 341 | 438 |
| ha1g__02153 | 51 | 148 | 245 | 65 C. | 342 | 439 |
| ha1g__02319 | 52 | 149 | 246 | 65 C. | 343 | 440 |
| ha1g__02335 | 53 | 150 | 247 | 65 C. | 344 | 441 |
| ha1p16__00182 | 54 | 151 | 248 | 65 C. | 345 | 442 |
| ha1p16__00185 | 55 | 152 | 249 | 65 C. | 346 | 443 |
| ha1p16__00193 | 56 | 153 | 250 | 65 C. | 347 | 444 |
| ha1p16__00259 | 57 | 154 | 251 | 65 C. | 348 | 445 |
| ha1p__02799 | 58 | 155 | 252 | 65 C. | 349 | 446 |
| ha1p__03567 | 59 | 156 | 253 | 65 C. | 350 | 447 |
| ha1p__03671 | 60 | 157 | 254 | 65 C. | 351 | 448 |
| ha1p__05803 | 61 | 158 | 255 | 65 C. | 352 | 449 |

TABLE 2-continued

Sequence identification numbers for all sequences described in the application. See, section "SEQUENCE LISTING" for actual sequences as listed by number in the table.

| Feature Name | Locus Number (SEQ ID NO:) | Left Primer (SEQ ID NO:) | Right Primer (SEQ ID NO:) | Annealing Temp. | Amplicon Seq. (SEQ ID NO:) | DNA Region Seq. (SEQ ID NO:) |
|---|---|---|---|---|---|---|
| ha1p__07131 | 62 | 159 | 256 | 65 C. | 353 | 450 |
| ha1p__07989 | 63 | 160 | 257 | 65 C. | 354 | 451 |
| ha1p__08588 | 64 | 161 | 258 | 65 C. | 355 | 452 |
| ha1p__09700 | 65 | 162 | 259 | 65 C. | 356 | 453 |
| ha1p__104458 | 66 | 163 | 260 | 65 C. | 357 | 454 |
| ha1p__105287 | 67 | 164 | 261 | 65 C. | 358 | 455 |
| ha1p__10702 | 68 | 165 | 262 | 65 C. | 359 | 456 |
| ha1p__108469 | 69 | 166 | 263 | 65 C. | 360 | 457 |
| ha1p__108849 | 70 | 167 | 264 | 65 C. | 361 | 458 |
| ha1p__11016 | 71 | 168 | 265 | 65 C. | 362 | 459 |
| ha1p__11023 | 72 | 169 | 266 | 65 C. | 363 | 460 |
| ha1p__12974 | 73 | 170 | 267 | 65 C. | 364 | 461 |
| ha1p__16027 | 74 | 171 | 268 | 65 C. | 365 | 462 |
| ha1p__16066 | 75 | 172 | 269 | 65 C. | 366 | 463 |
| ha1p__18911 | 76 | 173 | 270 | 65 C. | 367 | 464 |
| ha1p__19254 | 77 | 174 | 271 | 65 C. | 368 | 465 |
| ha1p__19853 | 78 | 175 | 272 | 65 C. | 369 | 466 |
| ha1p__22257 | 79 | 176 | 273 | 65 C. | 370 | 467 |
| ha1p__22519 | 80 | 177 | 274 | 65 C. | 371 | 468 |
| ha1p__31800 | 81 | 178 | 275 | 65 C. | 372 | 469 |
| ha1p__33290 | 82 | 179 | 276 | 65 C. | 373 | 470 |
| ha1p__37635 | 83 | 180 | 277 | 65 C. | 374 | 471 |
| ha1p__39189 | 84 | 181 | 278 | 65 C. | 375 | 472 |
| ha1p__39511 | 85 | 182 | 279 | 65 C. | 376 | 473 |
| ha1p__39752 | 86 | 183 | 280 | 65 C. | 377 | 474 |
| ha1p__60945 | 87 | 184 | 281 | 65 C. | 378 | 475 |
| ha1p__62183 | 88 | 185 | 282 | 65 C. | 379 | 476 |
| ha1p__69418 | 89 | 186 | 283 | 65 C. | 380 | 477 |
| ha1p__71224 | 90 | 187 | 284 | 65 C. | 381 | 478 |
| ha1p__74221 | 91 | 188 | 285 | 65 C. | 382 | 479 |
| ha1p__76289 | 92 | 189 | 286 | 65 C. | 383 | 480 |
| ha1p__81050 | 93 | 190 | 287 | 65 C. | 384 | 481 |
| ha1p__81674 | 94 | 191 | 288 | 65 C. | 385 | 482 |
| ha1p__86355 | 95 | 192 | 289 | 65 C. | 386 | 483 |
| ha1p__98491 | 96 | 193 | 290 | 65 C. | 387 | 484 |
| ha1p__99426 | 97 | 194 | 291 | 65 C. | 388 | 485 |

Example 3

Verification of Microarray DNA Methylation Predictions

Initially, the DNA methylation state of the loci was independently assayed in 10 ovarian carcinoma samples and the 10 histologically normal samples described above (i.e. the discovery tissue panel used for microarray experiments). DNA methylation was assayed by a quantitative PCR approach utilizing digestion by the McrBC restriction enzyme to monitor DNA methylation status. Genomic DNA purified from each sample was split into two equal portions of 9.6 µg. One 9.6 µg portion (Treated Portion) was digested with McrBC in a total volume of 120 µL including 1×NEB2 buffer (New England Biolabs), 0.1 mg/mL bovine serum albumin (New England Biolabs), 2 mM GTP (Roche) and 80 units of McrBC enzyme (New England Biolabs). The second 9.6 µg portion (Untreated Portion) was treated exactly the same as the Treated Portion, except that 8 µL of sterile 50% glycerol was added instead of McrBC enzyme. Reactions were incubated at 37° C. for approximately 12 hours, followed by incubation at 60° C. for 20 minutes to inactivate McrBC.

The extent of McrBC cleavage at each locus was monitored by quantitative real-time PCR (qPCR). For each assayed locus, qPCR was performed using 20 ng of the Untreated Portion DNA as template and, separately, using 20 ng of the Treated Portion DNA as template. Each reaction was performed in 10 µL total volume including 1× LightCycler 480 SYBR Green I Master mix (Roche) and 625 nM of each primer. Reactions were run in a Roche LightCycler 480 instrument. Optimal annealing temperatures varied depending on the primer pair. Primer sequences (Left Primer; Right Primer) and appropriate annealing temperatures (Annealing Temp.) are shown in Table 2. Cycling conditions were: 95° C. for 5 min.; 45 cycles of 95° C. for 1 min., [annealing temperature, see Table 2] for 30 sec., 72° C. for 1 min., 83° C. for 2 sec. followed by a plate read. Melting curves were calculated under the following conditions: 95° C. for 5 sec., 65° C. for 1 min., 65° C. to 95° C. at 2.5° C./sec. ramp rate with continuous plate reads. Each Untreated/Treated qPCR reaction pair was performed in duplicate. The difference in the cycle number at which amplification crossed threshold (delta Ct) was calculated for each Untreated/Treated qPCR reaction pair by subtracting the Ct of the Untreated Portion from the Ct of the Treated Portion. Because McrBC-mediated cleavage between the two primers increases the Ct of the Treated Portion, increasing delta Ct values reflect increasing measurements of local DNA methylation densities. The average delta Ct between the two replicate Untreated/Treated qPCR reactions was calculated, as well as the standard deviation between the two delta Ct values.

Example 4

Validation of DNA Methylation Changes in Larger Number of Independent Ovarian Tumor, Normal Ovarian Samples, and Normal Blood Samples The differential DNA methylation status of the loci was further validated by analyzing an independent panel of 26 ovarian carcinoma samples (17 Stage I and 9 Stage II), 27 normal ovarian tissue samples, and 23 normal blood samples. The normal ovarian tissues included in this panel were obtained from mastectomies unrelated to ovarian cancer. Each sample was split into two equal portions of 4 μg. One portion was digested with McrBC (Treated Portion) in a total volume of 200 μL including 1×NEB2 buffer (New England Biolabs), 0.1 mg/mL bovine serum albumin (New England Biolabs), 2 mM GTP (Roche) and 32 units McrBC (New England Biolabs). The second portion was mock treated under identical conditions, except that 3.2 μL sterile 50% glycerol was added instead of McrBC enzyme (Untreated Portion). Samples were incubated at 37° C. for approximately 12 hours, followed by incubation at 60° C. to inactivate the McrBC enzyme. qPCR reactions and data analysis were performed as described in Example 3.

Table 3 indicates the percent sensitivity and specificity for each locus. Gain biomarkers are biomarkers that show more methylation in tumor samples than normal samples and loss biomarkers show conversely. For gain biomarkers, sensitivity reflects the frequency of scoring a known tumor sample as positive for DNA methylation at each locus while specificity reflects the frequency of scoring a known normal sample as negative for DNA methylation at each locus. For loss biomarkers, sensitivity reflects the frequency of scoring a known tumor sample as negative for DNA methylation at each locus while specificity reflects the frequency of scoring a known normal sample as positive for DNA methylation at each locus. As described above, an average delta Ct>1.0 (Treated Portion−Untreated Portion) was used as a threshold to score a sample as positive for DNA methylation at each locus (representing >50% depletion of amplifiable molecules in the DNA methylation-dependent restricted population relative to the untreated population). Percent sensitivity of gain biomarkers was calculated as the number of tumor samples with an average delta Ct>1.0 divided by the total number of tumor samples analyzed for that locus (i.e. excluding any measurements with a standard deviation between qPCR replicates >1 cycle)×100. Percent specificity of gain biomarkers was calculated as (1−(the number of normal samples with an average delta Ct>1.0 divided by the total number of normal samples analyzed for that locus))×100. On the contrary percent sensitivity and specificity of loss biomarkers was calculated vice versa. As shown in Table 3, the loci have sensitivities >8% and specificities relative to normal ovarian samples >40%. Notably, at least 9 of the loci have 100% specificity relative to normal ovarian and relative to normal blood samples. It is important to point out that the sensitivity and specificity of the differential DNA methylation status of any given locus may be increased by further optimization of the precise local genetic region interrogated by a DNA methylation-sensing assay.

TABLE 3

Sensitivity and Specificity of Differentially Methylated Loci in a Panel of 26 Ovarian Tumor Samples, 27 Normal Ovarian Samples, and 23 Normal Blood Samples

| Feature Name | Locus No. | Sensitivity | Specificity vs Normal Ovary | Specificity vs Normal Blood |
|---|---|---|---|---|
| CHR01P001976799 | 1 | 96% | 100% | 0% |
| CHR01P026794862 | 2 | 43% | 60% | 89% |
| CHR01P043164342 | 3 | 42% | 100% | 100% |
| CHR01P063154999 | 4 | 85% | 100% | 100% |
| CHR01P204123050 | 5 | 76% | 42% | 5% |
| CHR01P206905110 | 6 | 38% | 100% | 100% |
| CHR01P225608458 | 7 | 85% | 63% | 4% |
| CHR02P005061785 | 8 | 100% | 89% | 0% |
| CHR02P042255672 | 9 | 81% | 100% | 0% |
| CHR02P223364582 | 10 | 92% | 52% | 100% |
| CHR03P027740753 | 11 | 77% | 100% | 100% |
| CHR03P052525960 | 12 | 85% | 67% | 0% |
| CHR03P069745999 | 13 | 8% | 100% | 100% |
| CHR05P059799713 | 14 | 42% | 100% | 100% |
| CHR05P059799813 | 15 | 35% | 100% | 100% |
| CHR05P177842690 | 16 | 62% | 96% | 95% |
| CHR06P010694062 | 17 | 88% | 63% | 0% |
| CHR06P026333318 | 18 | 96% | 89% | 0% |
| CHR08P102460854 | 19 | 84% | 93% | 0% |
| CHR08P102461254 | 20 | 76% | 96% | 0% |
| CHR08P102461554 | 21 | 80% | 96% | 0% |
| CHR09P000107988 | 22 | 73% | 96% | 91% |
| CHR09P021958839 | 23 | 88% | 92% | 90% |
| CHR09P131048752 | 24 | 96% | 96% | 0% |
| CHR10P118975684 | 25 | 35% | 100% | 0% |
| CHR11P021861414 | 26 | 19% | 100% | 100% |
| CHR12P004359362 | 27 | 38% | 96% | 87% |
| CHR12P016001231 | 28 | 50% | 96% | 80% |
| CHR14P018893344 | 29 | 85% | 96% | 0% |
| CHR14P093230340 | 30 | 92% | 89% | 100% |
| CHR16P000373719 | 31 | 38% | 100% | 0% |
| CHR16P066389027 | 32 | 15% | 96% | 100% |
| CHR16P083319654 | 33 | 38% | 93% | 87% |
| CHR18P019705147 | 34 | 31% | 100% | 100% |
| CHR19P018622408 | 35 | 92% | 100% | 0% |
| CHR19P051892823 | 36 | 78% | 89% | 10% |
| CHRXP013196410 | 37 | 96% | 83% | 14% |
| CHRXP013196870 | 38 | 96% | 80% | 9% |
| ha1p16__00179__l50 | 39 | 88% | 96% | 100% |
| ha1p16__00182__l50 | 40 | 81% | 96% | 100% |
| ha1p16__00257__l50 | 41 | 81% | 86% | 100% |
| ha1p__12601__l50 | 42 | 69% | 100% | 0% |
| ha1p__17147__l50 | 43 | 56% | 100% | 13% |
| ha1p__42350__l50 | 44 | 43% | 96% | 0% |
| ha1p__44897__l50 | 45 | 96% | 40% | 0% |
| ha1p__61253__l50 | 46 | 71% | 95% | 0% |
| CHR01P001005050 | 47 | 76% | 100% | 100% |
| CHR16P001157479 | 48 | 29% | 100% | 100% |

Example 5

Validation of DNA Methylation Changes in Independent Lung Tumor, Normal Lung Samples and in Normal Peripheral Blood Samples The differential DNA methylation status of the 49 loci was validated by analyzing an independent panel of 4 lung non-small adenocarcinoma samples (1 Stage I, 1 Stage II, 1 Stage III, 1 Stage IV) and 4 matched adjacent histologically normal as well as in 23 samples of peripheral blood of normal individuals. Each sample was split into two equal portions of 4 μg. One portion was digested with McrBC (Treated Portion) in a total volume of 200 μL including 1×NEB2 buffer (New England Biolabs), 0.1 mg/mL bovine serum albumin (New England Biolabs), 2 mM GTP (Roche) and 32 units McrBC (New England Biolabs). The second portion was mock treated under identical conditions, except that 3.2 μL sterile 50% glycerol was added instead of McrBC enzyme (Untreated Portion). Samples were incubated at 37° C. for approximately 12 hours, followed by incubation at 60° C. to inactivate the McrBC enzyme. qPCR reactions and data analysis were performed as described in these Examples.

Table 4 indicates the percent sensitivity and specificity for each locus. Gain biomarkers are biomarkers that show more methylation in tumor samples than normal samples and loss biomarkers show conversely. For gain biomarkers, sensitivity reflects the frequency of scoring a known tumor sample as positive for DNA methylation at each locus while specificity reflects the frequency of scoring a known normal sample as negative for DNA methylation at each locus. For loss biomarkers, sensitivity reflects the frequency of scoring a known tumor sample as negative for DNA methylation at each locus while specificity reflects the frequency of scoring a known normal sample as positive for DNA methylation at each locus. As described above, an average delta Ct>1.0 (Treated Portion−Untreated Portion) was used as a threshold to score a sample as positive for DNA methylation at each locus (representing >50% depletion of amplifiable molecules in the DNA methylation-dependent restricted population relative to the untreated population). Percent sensitivity of gain biomarkers was calculated as the number of tumor samples with an average delta Ct>1.0 divided by the total number of tumor samples analyzed for that locus (i.e. excluding any measurements with a standard deviation between qPCR replicates >1 cycle)×100. Percent specificity of gain biomarkers was calculated as (1−(the number of normal samples with an average delta Ct>1.0 divided by the total number of normal samples analyzed for that locus))×100. On the contrary percent sensitivity and specificity of loss biomarkers was calculated vice versa. As shown in Table 4, the 49 loci have sensitivities >32% up to 100% and specificities in range 8-100% in tissues and in range 0-100% specificity in peripheral blood. Notably, 33 of the 49 loci have 100% specificity in tissues, and 19 of the 49 loci have 100% specificity in blood. It is important to point out that the sensitivity and specificity of the differential DNA methylation status of any given locus may be increased by further optimization of the precise local genetic region interrogated by a DNA methylation-sensing assay.

TABLE 4

Sensitivity and specificity of Differentially Methylated Loci in a Panel Of 13 Adjacent Normal Lung Samples, 13 Lung Tumor Samples and 23 Normal Blood Samples

| Locus | | | Specificity | |
|---|---|---|---|---|
| Feature Name | Number | Sensitivity | Adj. normal | Blood |
| ha1g__00681 | 49 | 58% | 100% | 0% |
| ha1g__01966 | 50 | 75% | 100% | 95% |
| ha1g__02153 | 51 | 67% | 100% | 100% |
| ha1g__02319 | 52 | 50% | 100% | 100% |
| ha1g__02335 | 53 | 64% | 100% | 0% |
| ha1p__02799 | 58 | 38% | 100% | 95% |
| ha1p__03567 | 59 | 77% | 85% | 89% |
| ha1p__03671 | 60 | 33% | 100% | 100% |
| ha1p__05803 | 61 | 77% | 92% | 23% |
| ha1p__07131 | 62 | 38% | 100% | 100% |
| ha1p__07989 | 63 | 62% | 100% | 100% |
| ha1p__08588 | 64 | 54% | 100% | 100% |
| ha1p__09700 | 65 | 38% | 100% | 94% |
| ha1p__104458 | 66 | 100% | 77% | 0% |
| ha1p__105287 | 67 | 69% | 100% | 100% |
| ha1p__10702 | 68 | 62% | 100% | 80% |
| ha1p__108469 | 69 | 62% | 100% | 100% |
| ha1p__108849 | 70 | 92% | 31% | 0% |
| ha1p__11016 | 71 | 100% | 15% | 0% |

TABLE 4-continued

Sensitivity and specificity of Differentially Methylated Loci in a Panel Of 13 Adjacent Normal Lung Samples, 13 Lung Tumor Samples and 23 Normal Blood Samples

| Locus | | | Specificity | |
|---|---|---|---|---|
| Feature Name | Number | Sensitivity | Adj. normal | Blood |
| ha1p__11023 | 72 | 92% | 8% | 26% |
| ha1p__12974 | 73 | 46% | 100% | 100% |
| ha1p__16027 | 74 | 54% | 100% | 100% |
| ha1p__16066 | 75 | 85% | 100% | 95% |
| ha1p__18911 | 76 | 100% | 23% | 95% |
| ha1p__19254 | 77 | 77% | 100% | 44% |
| ha1p__19853 | 78 | 69% | 100% | 100% |
| ha1p__22257 | 79 | 64% | 100% | 91% |
| ha1p__22519 | 80 | 77% | 92% | 91% |
| ha1p__31800 | 81 | 100% | 31% | 50% |
| ha1p__33290 | 82 | 83% | 92% | 50% |
| ha1p__37635 | 83 | 91% | 100% | 45% |
| ha1p__39189 | 84 | 50% | 100% | 100% |
| ha1p__39511 | 85 | 100% | 27% | 31% |
| ha1p__39752 | 86 | 75% | 77% | 85% |
| ha1p__60945 | 87 | 85% | 15% | 21% |
| ha1p__62183 | 88 | 50% | 100% | 95% |
| ha1p__69418 | 89 | 75% | 100% | 100% |
| ha1p__71224 | 90 | 92% | 83% | 67% |
| ha1p__74221 | 91 | 64% | 100% | 42% |
| ha1p__76289 | 92 | 64% | 100% | 90% |
| ha1p__81050 | 93 | 54% | 100% | 100% |
| ha1p__81674 | 94 | 83% | 92% | 100% |
| ha1p__86355 | 95 | 69% | 83% | 94% |
| ha1p__98491 | 96 | 54% | 100% | 100% |
| ha1p__99426 | 97 | 62% | 100% | 100% |
| ha1p16__00182 | 54 | 38% | 100% | 94% |
| ha1p16__00185 | 55 | 38% | 100% | 100% |
| ha1p16__00193 | 56 | 92% | 77% | 100% |
| ha1p16__00259 | 57 | 82% | 85% | 95% |

Example 6

Further Validation of Selected DNA Methylation Biomarkers in a Larger Panel of Lung Tumor Samples and Normal Lung Samples A panel of 37 loci were selected for further validation in a panel of 25 additional lung carcinoma samples as well as 25 additional matched adjacent histologically normal samples, bringing the total number of tumor and normal samples analyzed to 38. The panel also included 22 lung samples from individuals who died from reasons other than cancer (i.e., benign samples). Samples were treated and analyzed as described in these Examples. As shown in Table 5, these loci display greater than 19% sensitivity, and all of them showed greater than 70% specificity relative to normal lung tissue, and 30 showed greater than 90% specificity relative to normal peripheral blood.

To address the applicability of the differential DNA methylation events as biomarkers for additional tumor types, a subset of claimed loci were analyzed in a panel of 10 cervical tumor samples and 8 benign cervical samples. All tumors were squamous cell cervical carcinomas with histology-confirmed neoplastic cellularity ranging from 75% to 95%. Benign cervical samples were obtained from hysterectomies of cervical cancer-free women. Some loci listed in Table 5 were analyzed using the same qPCR based assays as described in Example 3. Receiver-operator characteristic analysis (Lasko, et al. (2005) *Journal of Biomedical Informatics* 38(5):404-415.) was used to determine empirical threshold values for classification of tissue samples. The analysis was performed independently for each locus. Resulting sensitivity and specificity calculations are shown in Table 5 (columns labeled "cervical"). These results demonstrate that loci discovered to be differentially methylated in lung tumors relative to normal or benign tissue can also be relevant biomarkers of cancers other than lung cancer.

diseased ovary) and Tumor vs. Blood. In Table 6, the calculated sensitivity and specificity are reported for both of the paradigms. In each case, sensitivity is reported as the true

TABLE 5

Sensitivity and specificity of differentially methylated loci in a panel of 22 benign lung samples, 38 adjacent normal samples, 38 lung tumor samples and 23 normal blood samples using ROC analysis

| | Adjacent & Benign | | Adjacent Normal | | Benign Samples | | Blood | | Cervical | |
|---|---|---|---|---|---|---|---|---|---|---|
| Feature Name | Sensitivity | Specificity | Sensitivity | Specificity | Sensitivity | Specificity | Sensitivity | Specificity | Sensitivity | Specificity |
| ha1g__01966 | 84.21% | 85.00% | 84.21% | 84.21% | 89.47% | 90.91% | 84.21% | 82.61% | 90.00% | 87.50% |
| ha1g__02153 | 78.95% | 78.33% | 78.95% | 78.95% | 78.95% | 77.27% | 86.84% | 100.00% | 100.00% | 100.00% |
| ha1g__02319 | 84.21% | 85.00% | 78.95% | 81.58% | 86.84% | 86.36% | 94.74% | 95.65% | 90.00% | 87.50% |
| ha1p__02799 | 60.53% | 60.00% | 60.53% | 60.53% | 60.53% | 59.09% | 81.58% | 82.61% | — | — |
| ha1p__03567 | 84.21% | 85.00% | 81.58% | 81.58% | 86.84% | 86.36% | 78.95% | 78.26% | — | — |
| ha1p__03671 | 65.79% | 68.33% | 65.79% | 65.79% | 65.79% | 68.18% | 78.95% | 78.26% | 80.00% | 75.00% |
| ha1p__07131 | 89.47% | 88.33% | 86.84% | 86.84% | 92.11% | 90.91% | 94.74% | 95.65% | 70.00% | 75.00% |
| ha1p__07989 | 84.21% | 85.00% | 84.21% | 84.21% | 86.84% | 86.36% | 84.21% | 82.61% | — | — |
| ha1p__08588 | 84.21% | 85.00% | 84.21% | 81.58% | 86.84% | 86.36% | 86.84% | 86.96% | 60.00% | 62.50% |
| ha1p__09700 | 68.42% | 68.33% | 68.42% | 68.42% | 68.42% | 68.18% | 63.16% | 65.22% | — | — |
| ha1p__105287 | 78.95% | 80.00% | 78.95% | 78.95% | 84.21% | 86.36% | 94.74% | 95.65% | 70.00% | 75.00% |
| ha1p__10702 | 63.16% | 66.67% | 63.16% | 73.68% | 63.16% | 63.64% | 63.16% | 78.26% | — | — |
| ha1p__108469 | 78.95% | 78.33% | 81.58% | 81.58% | 78.95% | 77.27% | 86.84% | 86.96% | 70.00% | 62.50% |
| ha1p__12974 | 57.89% | 58.33% | 52.63% | 52.63% | 65.79% | 68.18% | 76.32% | 100.00% | 80.00% | 75.00% |
| ha1p__16027 | 78.95% | 78.33% | 76.32% | 76.32% | 86.84% | 86.36% | 100.00% | 100.00% | 70.00% | 75.00% |
| ha1p__16066 | 78.95% | 80.00% | 78.95% | 78.95% | 81.58% | 81.82% | 92.11% | 91.30% | — | — |
| ha1p__18911 | 73.68% | 73.33% | 73.68% | 73.68% | 73.68% | 72.73% | 76.32% | 78.26% | 60.00% | 62.50% |
| ha1p__19853 | 86.84% | 86.67% | 86.84% | 86.84% | 86.84% | 86.36% | 92.11% | 91.30% | 90.00% | 87.50% |
| ha1p__22257 | 76.32% | 76.67% | 78.95% | 78.95% | 68.42% | 68.18% | 73.68% | 73.91% | — | — |
| ha1p__22519 | 84.21% | 83.33% | 81.58% | 81.58% | 84.21% | 86.36% | 68.42% | 69.57% | — | — |
| ha1p__31800 | 84.21% | 83.33% | 89.47% | 86.84% | 81.58% | 81.82% | 60.53% | 60.87% | — | — |
| ha1p__33290 | 89.47% | 90.00% | 89.47% | 89.47% | 86.84% | 86.36% | 52.63% | 52.17% | — | — |
| ha1p__39189 | 84.21% | 83.33% | 84.21% | 84.21% | 84.21% | 86.36% | 81.58% | 78.26% | — | — |
| ha1p__39752 | 65.79% | 65.00% | 68.42% | 68.42% | 57.89% | 59.09% | 86.84% | 86.96% | — | — |
| ha1p__62183 | 84.21% | 83.33% | 81.58% | 81.58% | 86.84% | 86.36% | 94.74% | 95.65% | — | — |
| ha1p__69418 | 86.84% | 86.67% | 86.84% | 86.84% | 89.47% | 90.91% | 100.00% | 100.00% | 70.00% | 75.00% |
| ha1p__71224 | 76.32% | 76.67% | 76.32% | 76.32% | 76.32% | 77.27% | 78.95% | 78.26% | — | — |
| ha1p__76289 | 73.68% | 73.33% | 73.68% | 73.68% | 73.68% | 72.73% | 76.32% | 78.26% | — | — |
| ha1p__81050 | 89.47% | 90.00% | 84.21% | 84.21% | 94.74% | 95.45% | 94.74% | 95.65% | 70.00% | 75.00% |
| ha1p__81674 | 65.79% | 68.33% | 71.05% | 68.42% | 63.16% | 63.64% | 63.16% | 65.22% | 50.00% | 50.00% |
| ha1p__86355 | 57.89% | 56.67% | 55.26% | 55.26% | 60.53% | 59.09% | 84.21% | 82.61% | — | — |
| ha1p__98491 | 55.26% | 55.00% | 55.26% | 55.26% | 52.63% | 54.55% | 92.11% | 91.30% | 60.00% | 62.50% |
| ha1p__99426 | 86.84% | 88.33% | 86.84% | 86.84% | 86.84% | 86.36% | 94.74% | 95.65% | 100.00% | 100.00% |
| ha1p16__00182 | 78.95% | 78.33% | 76.32% | 76.32% | 81.58% | 81.82% | 89.47% | 91.30% | 90.00% | 87.50% |
| ha1p16__00185 | 76.32% | 76.67% | 76.32% | 76.32% | 76.32% | 77.27% | 84.21% | 86.96% | 100.00% | 100.00% |
| ha1p16__00193 | 78.95% | 78.33% | 73.68% | 73.68% | 84.21% | 86.36% | 86.84% | 86.96% | 80.00% | 75.00% |
| ha1p16__00259 | 78.95% | 78.33% | 78.95% | 78.95% | 78.95% | 81.82% | 78.95% | 82.61% | — | — |
| TH2B | 76.32% | 76.67% | 73.68% | 73.68% | 78.95% | 77.27% | 86.84% | 100.00% | — | — |

Example 7

Determination of Sensitivity and Specificity by Receiver Operating Characteristics (ROC) Analysis Receiver Operating Characteristic (ROC) analysis (see Lasko et al, *Journal of Biomedical Informatics* 38(5):404-415 (2005)) was used to determine empirical cut-off values for classification of tissue samples. The analysis was performed independently for each of the forty-two loci, as well as for each of the following comparisons: Tumor vs. Normal (non-diseased ovary) and Tumor vs. Blood. In Table 6, the calculated sensitivity and specificity are reported for both of the paradigms. In each case, sensitivity is reported as the true positive rate and 1-specificity is reported as the false positive rate. For each depicted locus, sensitivity refers to the percentage of tumor samples that report a value above (for a gain of DNA methylation event in tumor) or below (for a loss of DNA methylation event in tumor) a threshold value determined by ROC analysis. Specificity refers to the percentage of normal samples that report a value below (for a gain of DNA methylation event in tumor) or above (for a loss of DNA methylation event in tumor) a threshold value determined by ROC analysis.

TABLE 6

Sensitivity and Specificity of Differentially Methylated Loci as Determined by ROC Analysis in a Panel of Tumor Ovary vs. Normal Ovary (Normal), Tumor Ovary vs. Normal Blood (Blood) and Tumor Cervix vs. Normal Cervix (Cervical)

| | Feature | Normal | | Blood | | Cervical | |
|---|---|---|---|---|---|---|---|
| Feature Name | Seq | Sensitivity | Specificity | Sensitivity | Specificity | Sensitivity | Specificity |
| CHR01P001976799 | 1 | 96.15% | 96.30% | 73.08% | 86.96% | — | — |
| CHR01P026794862 | 2 | 46.15% | 44.44% | 69.23% | 69.57% | — | — |
| CHR01P043164342 | 3 | 92.31% | 100.00% | 88.46% | 86.96% | 80.00% | 75.00% |

TABLE 6-continued

Sensitivity and Specificity of Differentially Methylated Loci as Determined by ROC Analysis in a Panel of Tumor Ovary vs. Normal Ovary (Normal), Tumor Ovary vs. Normal Blood (Blood) and Tumor Cervix vs. Normal Cervix (Cervical)

| Feature Name | Feature Seq | Normal Sensitivity | Normal Specificity | Blood Sensitivity | Blood Specificity | Cervical Sensitivity | Cervical Specificity |
|---|---|---|---|---|---|---|---|
| CHR01P063154999 | 4 | 96.15% | 96.30% | 100.00% | 100.00% | 90.00% | 87.50% |
| CHR01P204123050 | 5 | 65.38% | 66.67% | 65.38% | 65.22% | — | — |
| CHR01P206905110 | 6 | 92.31% | 96.30% | 88.46% | 86.96% | 80.00% | 75.00% |
| CHR01P225608458 | 7 | 80.77% | 81.48% | 50.00% | 47.83% | — | — |
| CHR02P005061785 | 8 | 96.15% | 96.30% | 80.77% | 86.96% | — | — |
| CHR02P042255672 | 9 | 92.31% | 92.59% | 73.08% | 73.91% | — | — |
| CHR02P223364582 | 10 | 88.46% | 88.89% | 92.31% | 91.30% | 70.00% | 75.00% |
| CHR03P027740753 | 11 | 88.46% | 88.89% | 88.46% | 86.96% | 100.00% | 100.00% |
| CHR03P052525960 | 12 | 76.92% | 77.78% | 84.62% | 82.61% | 60.00% | 62.50% |
| CHR03P069745999 | 13 | 80.77% | 81.48% | 69.23% | 69.57% | — | — |
| CHR05P059799713 | 14 | 69.23% | 70.37% | 92.31% | 91.30% | 60.00% | 62.50% |
| CHR05P059799813 | 15 | 73.08% | 74.07% | 96.15% | 95.65% | 80.00% | 75.00% |
| CHR05P177842690 | 16 | 84.62% | 85.19% | 80.77% | 78.26% | — | — |
| CHR06P010694062 | 17 | 88.46% | 88.89% | 69.23% | 69.57% | — | — |
| CHR06P026333318 | 18 | 96.15% | 96.30% | 73.08% | 73.91% | — | — |
| CHR08P102460854 | 19 | 88.46% | 88.89% | 76.92% | 100.00% | — | — |
| CHR08P102461254 | 20 | 92.31% | 92.59% | 88.46% | 100.00% | 80.00% | 75.00% |
| CHR08P102461554 | 21 | 88.46% | 88.89% | 92.31% | 100.00% | 80.00% | 75.00% |
| CHR09P000107988 | 22 | 84.62% | 85.19% | 84.62% | 82.61% | 90.00% | 87.50% |
| CHR09P021958839 | 23 | 88.46% | 88.89% | 92.31% | 91.30% | 90.00% | 87.50% |
| CHR09P131048752 | 24 | 96.15% | 96.30% | 73.08% | 73.91% | — | — |
| CHR10P118975684 | 25 | 76.92% | 77.78% | 88.46% | 86.96% | 100.00% | 100.00% |
| CHR11P021861414 | 26 | 65.38% | 66.67% | 61.54% | 60.87% | — | — |
| CHR12P004359362 | 27 | 80.77% | 81.48% | 65.38% | 65.22% | — | — |
| CHR12P016001231 | 28 | 73.08% | 74.07% | 65.38% | 65.22% | — | — |
| CHR14P018893344 | 29 | 92.31% | 92.59% | 88.46% | 86.96% | 100.00% | 100.00% |
| CHR14P093230340 | 30 | 92.31% | 92.59% | 100.00% | 100.00% | 90.00% | 87.50% |
| CHR16P066389027 | 32 | 73.08% | 74.07% | 80.77% | 91.30% | 60.00% | 62.50% |
| CHR16P083319654 | 33 | 76.92% | 77.78% | 69.23% | 69.57% | — | — |
| CHR18P019705147 | 34 | 96.15% | 96.30% | 80.77% | 82.61% | 90.00% | 87.50% |
| CHR19P018622408 | 35 | 92.31% | 92.59% | 84.62% | 82.61% | 100.00% | 100.00% |
| CHRXP013196410 | 37 | 88.46% | 88.89% | 69.23% | 69.57% | — | — |
| CHRXP013196870 | 38 | 88.46% | 88.89% | 76.92% | 78.26% | — | — |
| ha1p16__00179__l50 | 39 | 88.46% | 88.89% | 92.31% | 91.30% | 90.00% | 87.50% |
| ha1p16__00182__l50 | 40 | 92.31% | 92.59% | 96.15% | 95.65% | 80.00% | 75.00% |
| ha1p__12601__l50 | 42 | 92.31% | 92.59% | 69.23% | 69.57% | — | — |
| ha1p__17147__l50 | 43 | 92.31% | 92.59% | 50.00% | 47.83% | — | — |
| ha1p__42350__l50 | 44 | 61.54% | 62.96% | 96.15% | 95.65% | 70.00% | 75.00% |
| ha1p__44897__l50 | 45 | 92.31% | 88.89% | 53.85% | 52.17% | — | — |
| CHR01P001005050 | 47 | 100.00% | 100.00% | 100.00% | 100.00% | 80.00% | 100.00% |
| CHR16P001157479 | 48 | 92.86% | 100.00% | 100.00% | 100.00% | 71.43% | 100.00% |

Example 8

Discriminatory Analysis to Determine which Locus or Combination of Loci Best Differentiate Between Cancerous and Non-Cancerous Tissue To determine which locus or combination of loci best differentiate between cancerous (tumor) and non-cancerous (adjacent normal/benign disease) tissue, discriminant analysis (Fischer, R. A. "The Statistical Utilization of Multiple Measurements." Annals of Eugenics, 8 (1938), 376-386; Lachenbruch, P. A. *Discriminant Analysis*. New York: Hafner Press, 1975) was utilized. A training dataset consisted of delta Ct values for forty-two loci across a panel of ten tumor samples and ten normal samples. Discriminant analysis on the training set identified two combinations of four loci each that were able to correctly classify all twenty samples (i.e., error rate=0%) as shown in Tables 7 and 8. The models developed on the training set were validated on a test dataset of twenty-six tumor samples and twenty-seven normal samples. Error rates of 0% and 1.92% were achieved when classifying tumor vs. normal using each of the two models (see Table 9 and 10).

TABLE 7

Discriminant analysis results from training data, Model 1: CHR01P001976799, CHR14P093230340, ha1p__42350__l50, ha1p__44897__l50. Overall error rate = 0%.

| | | Predicted Group | | |
|---|---|---|---|---|
| | | Normal | Tumor | Total |
| Known Group | Normal | 27 | 0 | 27 |
| | | 100% | 0% | |
| | Tumor | 0 | 26 | 26 |
| | | 0% | 100% | |
| Total | | 27 | 26 | |

TABLE 8

Discriminant analysis results from training data, Model 2:
CHR14P093230340, ha1p__12601__l50,
ha1p__42350__l50, ha1p__44897__l50.
Overall error rate = 0%.

| | | Predicted Group | | |
|---|---|---|---|---|
| | | Normal | Tumor | Total |
| Known Group | Normal | 27<br>100% | 0<br>0% | 27 |
| | Tumor | 0<br>0% | 26<br>100% | 26 |
| | Total | 27 | 26 | |

TABLE 9

Discriminant analysis results from Model 1 (CHR01P001976799,
CHR14P093230340, ha1p__42350__l50,
ha1p__44897__l50) on test data.
Overall error rate = 0%.

| | | Predicted Group | | |
|---|---|---|---|---|
| | | Normal | Tumor | Total |
| Known Group | Normal | 27<br>100% | 0<br>0% | 27 |
| | Tumor | 0<br>0% | 26<br>100% | 26 |
| | Total | 27 | 26 | |

TABLE 10

Discriminant analysis results from Model 2 (CHR14P093230340,
ha1p__12601__l50, ha1p__42350__l50,
ha1p__44897__l50) on test data.
Overall error rate = 1.92%.

| | | Predicted Group | | |
|---|---|---|---|---|
| | | Normal | Tumor | Total |
| Known Group | Normal | 27<br>100% | 0<br>0% | 27 |
| | Tumor | 1<br>3.85% | 25<br>47.17% | 26 |
| | Total | 27 | 26 | |

Example 9

Selection of Sequence Identified as Potential Region of Differential DNA Methylation As described in the examples above, the loci identified as differentially methylated were originally discovered based on DNA methylation-dependent microarray analyses. The sequences of the microarray features reporting this differential methylation are indicated in Table 2 and in section "SEQUENCE LISTING." The "wingspan" of genomic interrogation by each array feature is proportional to the size of the sheared target at the beginning of the experiment (e.g., 1 to 4 Kbp), therefore regions of the genome comprising the probe participated the interrogation for differential methylation. Because the DNA was randomly sheared the effective genomic region scanned is roughly twice the size of the average molecular weight. The smallest fragments in the molecular population were 1 Kb, this suggests the minimum region size. The largest fragments were 4 Kb in size, suggesting that each probe cannot monitor DNA methylation that is more than 4 Kbp proximal or distal to each probe. PCR primers that amplify an amplicon within a 1 kb region surrounding the sequence represented by each microarray feature were selected and used for independent verification and validation experiments. Primer sequences and amplicon sequences are indicated in Table 2 and in section "SEQUENCE LISTING." To optimize successful PCR amplification, these amplicons were designed to be less than the entire 1 kb region represented by the wingspan of the microarray feature. However, it should be noted that differential methylation may be detectable anywhere within this 1-8 Kb sequence window adjacent to the probe.

In addition, the local CG density surrounding each region was calculated. Approximately 10 kb of sequence both upstream and downstream of each feature was extracted from the human genome. For each 20 kb portion of the genome, a sliding window of 500 bp moving in 100 bp steps was used to calculate the CG density. CG density was expressed as the ratio of CG dinucleotides per kb. In this example, it is obvious that a region anywhere within the ~4 kb peak of CG density associated with the promoter region of the gene could be monitored for DNA methylation and could be important in development of a clinical diagnostic assay. As an obvious consequence, the more CG rich the DNA is adjacent to the probe, the more likely it is that the sequence would function redundantly to its neighboring sequences. Because of the technology platform's ability to monitor this adjacent DNA for methylation differences, the sequences indicated in Table 2 (DNA Region sequences) and in section "SEQUENCE LISTING" were selected using an 8 Kb criteria.

Example 10

Applicability of DNA Methylation-Based Biomarkers in Additional Tumor Types

To address the applicability of the differential DNA methylation events as biomarkers for additional tumor types, a subset of claimed loci were analyzed in a panel of 10 cervical tumor samples and 8 benign cervical samples. All tumors were squamous cell cervical carcinomas with histology-confirmed neoplastic cellularity ranging from 75% to 95%. Benign cervical samples were obtained from hysterectomies of cervical cancer-free women. Loci listed in Table 5 (columns labeled "cervical") were analyzed using qPCR based assays. Receiver-operator characteristic analysis (Lasko, et al. (2005) Journal of Biomedical Informatics 38(5):404-415) was used to determine empirical threshold values for classification of tissue samples. The analysis was performed independently for each locus. Resulting sensitivity [the percentage of tumor samples above (gain biomarkers) or below (loss biomarkers) threshold] and specificity [the percentage of benign samples below (gain biomarkers) or above (loss biomarkers) threshold] calculations are shown in Table 5. These results demonstrate that loci discovered to be differentially methylated in tumors relative to normal or benign tissue are also relevant biomarkers of cancers.

Example 11

Bisulfite Sequencing Confirmation of Differential DNA Methylation of Additional Loci Confirmation of differential DNA methylation was performed by bisulfite sequencing. Primers were designed to amplify a 400 bp amplicon within the 500 bp region of locus halp16_00182_150 analyzed by qPCR (as discussed in the examples above) from bisulfite converted genomic DNA. Primers sequences lack CpG dinucleotides, and therefore amplify bisulfite converted DNA independently of DNA methylation status. Products were amplified from one tumor sample (positive for DNA methylation) and from one normal sample. Amplicons were purified and cloned using TA cloning kits (Invitrogen). Ninety-six (96) independent clones were sequenced for the tumor sample. Ninety-six (96) independent clones were sequenced for the normal sample. Bisulfite treatment results in conversion of unmethylated cytosines to uracil, but does not convert methylated cytosines. The percent methylation of each CpG dinucleotide within the region was calculated as the number of sequence reads of C at each CpG divided by the total number of sequence reads. All 9 CpG dinucleotides are methylated in the tumor (occupancy ranging from 93.62 to 100%). However, methylation occupancy of CpG dinucleotides in normal sample was lower, ranging from 0 to 10%.

To provide further confirmation of DNA methylation differences and to justify the qPCR based strategy for high-throughput detection of DNA methylation, three additional loci CHR01P043164342, CHR01P063154999, CHR03P027740753, were analyzed by bisulfite genomic sequencing as described above. Ninety six independent clones were sequenced per amplicon per sample. The sequencing results were consistent with the results of qPCR. Note that CHR01P043164342 is a DNA methylation loss marker, and this sequence is less methylated in tumor sample relative to the normal sample. In addition, two other loci were analyzed by bisulfite genomic sequencing as described above. Between 10 and 24 independent clones were sequenced per amplicon per sample. The sequencing results were in line with the qPCR results (see Table 11). Note that the CG Position column in Table 11 refers to the CG position in the amplicons used for bisulfite sequencing.

TABLE 11

Examples of Bisulfite Analysis of Differentially Methylated Loci.

| Feature Name | CG Position | % of Methylation | |
|---|---|---|---|
| | | Tumor | Benign |
| halp_03671 | 27 | 85% | 18% |
| | 58 | 90% | 27% |
| | 70 | 90% | 18% |
| | 79 | 85% | 9% |
| | 89 | 80% | 9% |
| | 96 | 85% | 9% |
| | 115 | 85% | 9% |
| | 125 | 83% | 9% |
| | 134 | 83% | 0% |
| # of clones | | 20 | 11 |
| qPCR result (delta Ct) | | 2.7 | 0.91 |

| | CG position | % Methylation | |
|---|---|---|---|
| | | Tumor | Adj. Normal |
| halp_08588 | 35 | 46% | 90% |
| | 67 | 38% | 82% |
| | 182 | 21% | 50% |
| | 200 | 7% | 40% |
| # of clones | | 24 | 11 |
| qPCR result (delta Ct) | | 0.95 | 6.23 |

TABLE 11-continued

Examples of Bisulfite Analysis of Differentially Methylated Loci.

| | CG position | % Methylation | |
|---|---|---|---|
| | | Tumor | Normal |
| CHR01P043164342 | 39 | 9.91% | 90.52% |
| | 51 | 7.21% | 75.68% |
| | 60 | 6.19% | 70.99% |
| | 87 | 10.00% | 92.86% |
| | 104 | 9.46% | 83.81% |
| | 139 | 3.77% | 32.56% |
| | 148 | 13.46% | 86.42% |
| | 174 | 9.80% | 61.54% |
| | 183 | 7.69% | 48.68% |
| | 255 | 6.38% | 67.27% |
| # of clones | | 96 | 96 |
| qPCR result (delta Ct) | | 0.025 | 7.46 |

| | CG position | % Methylation | |
|---|---|---|---|
| | | Tumor | Normal |
| CHR01P063154999 | 32 | 76.40% | 15.05% |
| | 34 | 96.63% | 7.53% |
| | 55 | 96.63% | 23.60% |
| | 66 | 92.13% | 4.44% |
| | 73 | 97.70% | 4.40% |
| | 89 | 94.32% | 2.20% |
| | 91 | 92.13% | 3.30% |
| | 94 | 93.18% | 0.00% |
| | 100 | 92.13% | 1.10% |
| | 110 | 97.73% | 1.14% |
| | 118 | 96.59% | 2.22% |
| | 128 | 97.73% | 2.25% |
| # of clones | | 96 | 96 |
| qPCR result (delta Ct) | | 4.14 | 0 |

| | CG position | % Methylation | |
|---|---|---|---|
| | | Tumor | Normal |
| CHR03P027740753 | 26 | 93.14% | 11.76% |
| | 28 | 96.04% | 17.6% |
| | 93 | 29.21% | 6.67% |
| | 136 | 52.24% | 0.00% |
| | 157 | 91.04% | 0.00% |
| | 159 | 92.42% | 0.00% |
| | 171 | 98.48% | 13.33% |
| | 180 | 81.54% | 14.29% |
| # of clones | | 96 | 96 |
| qPCR result (delta Ct) | | 4.675 | 0 |

Example 12

Analysis of DNA Methylation in Various Cancer Types

To address the applicability of the claimed DNA methylation biomarkers to cancer types other than one type of cancer, all claimed biomarkers were analyzed in panels of bladder, breast, cervical, colon, endometrial, esophageal, head and neck, liver, lung, melanoma, ovarian, prostate, renal, and thyroid tumors. Adjacent histology normal tissues were analyzed as controls. In addition, melanoma tumors were analyzed, although no adjacent normal tissues were available. The number of samples analyzed for each cancer type is provided in Table 12. DNA methylation was measured as described in these Examples. For each locus and each cancer type, the sensitivity and specificity for discriminating between tumor and adjacent normal tissues are reported in Tables 13-27. For melanoma tumors (Table 23), only sensitivity (the frequency of DNA methylation detection (ie. samples that report and average dCt≧1.0)) is reported due to the unavailability of adjacent normal tissues. For each locus, the optimal threshold for discriminating between tumor and adjacent normal tissue was calculated following ROC curve analysis. These data demonstrate that particular biomarker loci are applicable to more than just one cancer type.

TABLE 12

Number of tumor and normal samples tested for the biomarker loci.

| Cancer Type | Tumor | Normal |
|---|---|---|
| Bladder | 9 | 9 |
| Breast | 10 | 10 |
| Cervical | 10 | 9 |
| Colon | 10 | 10 |
| Endometrial | 14 | 9 |
| Esophageal | 9 | 10 |
| Head & Neck | 9 | 5 |
| Liver | 9 | 9 |
| Lung | 20 | 20 |
| Melanoma | 7 | 0 |
| Ovarian | 34 | 35 |
| Prostate | 9 | 9 |
| Renal | 10 | 10 |
| Thyroid | 10 | 10 |

TABLE 13

Sensitivity and Specificity of differentially methylated loci in bladder tumors relative to adjacent histological normal bladder tissue.

| Feature Name | Locus Number | Threshold | Sensitivity | Pos. of Total | Specificity | Neg. of Total |
|---|---|---|---|---|---|---|
| CHR01P001976799 | 1 | 6 | 77.78% | 7 of 9 | 88.89% | 8 of 9 |
| CHR01P026794862 | 2 | 0.52 | 62.50% | 5 of 8 | 50.00% | 3 of 6 |
| CHR01P043164342 | 3 | 4.69 | 66.67% | 6 of 9 | 77.78% | 7 of 9 |
| CHR01P063154999 | 4 | 0.955 | 100.00% | 9 of 9 | 66.67% | 6 of 9 |
| CHR01P204123050 | 5 | 1.265 | 50.00% | 4 of 8 | 100.00% | 7 of 7 |
| CHR01P206905110 | 6 | 2.685 | 88.89% | 8 of 9 | 88.89% | 8 of 9 |
| CHR01P225608458 | 7 | 1.655 | 100.00% | 9 of 9 | 88.89% | 8 of 9 |
| CHR02P005061785 | 8 | 4.945 | 66.67% | 6 of 9 | 75.00% | 6 of 8 |
| CHR02P042255672 | 9 | 2.5 | 66.67% | 6 of 9 | 77.78% | 7 of 9 |
| CHR02P223364582 | 10 | 1.65 | 66.67% | 6 of 9 | 100.00% | 9 of 9 |
| CHR03P027740753 | 11 | 1.225 | 100.00% | 9 of 9 | 100.00% | 8 of 8 |
| CHR03P052525960 | 12 | 3.225 | 88.89% | 8 of 9 | 100.00% | 9 of 9 |
| CHR03P069745999 | 13 | 3.255 | 55.56% | 5 of 9 | 66.67% | 6 of 9 |
| CHR05P059799713 | 14 | 1.13 | 77.78% | 7 of 9 | 55.56% | 5 of 9 |
| CHR05P059799813 | 15 | 0.715 | 100.00% | 8 of 8 | 37.50% | 3 of 8 |
| CHR05P177842690 | 16 | 2.79 | 77.78% | 7 of 9 | 50.00% | 4 of 8 |
| CHR06P010694062 | 17 | 4.32 | 66.67% | 6 of 9 | 100.00% | 9 of 9 |
| CHR06P026333318 | 18 | 4.31 | 77.78% | 7 of 9 | 100.00% | 9 of 9 |
| CHR08P102460854 | 19 | 0.805 | 77.78% | 7 of 9 | 100.00% | 9 of 9 |
| CHR08P102461254 | 20 | 1.09 | 88.89% | 8 of 9 | 100.00% | 9 of 9 |
| CHR08P102461554 | 21 | 0.97 | 77.78% | 7 of 9 | 88.89% | 8 of 9 |
| CHR09P000107988 | 22 | 1.65 | 88.89% | 8 of 9 | 100.00% | 9 of 9 |
| CHR09P021958839 | 23 | 1.73 | 77.78% | 7 of 9 | 88.89% | 8 of 9 |
| CHR09P131048752 | 24 | 4.21 | 88.89% | 8 of 9 | 100.00% | 9 of 9 |
| CHR10P118975684 | 25 | 1.295 | 77.78% | 7 of 9 | 66.67% | 6 of 9 |
| CHR11P021861414 | 26 | 2.96 | 88.89% | 8 of 9 | 88.89% | 8 of 9 |
| CHR12P004359362 | 27 | 2.25 | 66.67% | 6 of 9 | 77.78% | 7 of 9 |
| CHR12P016001231 | 28 | 0.965 | 25.00% | 2 of 8 | 100.00% | 8 of 8 |
| CHR14P018893344 | 29 | 3.335 | 55.56% | 5 of 9 | 100.00% | 8 of 8 |
| CHR14P093230340 | 30 | 1.91 | 77.78% | 7 of 9 | 85.71% | 6 of 7 |
| CHR16P000373719 | 31 | 1.305 | 100.00% | 8 of 8 | 75.00% | 3 of 4 |
| CHR16P066389027 | 32 | 1.47 | 55.56% | 5 of 9 | 77.78% | 7 of 9 |
| CHR16P083319654 | 33 | 1.575 | 66.67% | 6 of 9 | 100.00% | 9 of 9 |
| CHR18P019705147 | 34 | 3.85 | 100.00% | 9 of 9 | 55.56% | 5 of 9 |
| CHR19P018622408 | 35 | 2.795 | 100.00% | 9 of 9 | 87.50% | 7 of 8 |
| CHR19P051892823 | 36 | 2.095 | 80.00% | 4 of 5 | 100.00% | 4 of 4 |
| CHRXP013196410 | 37 | 2.63 | 66.67% | 6 of 9 | 88.89% | 8 of 9 |
| CHRXP013196870 | 38 | 2.255 | 55.56% | 5 of 9 | 55.56% | 5 of 9 |
| ha1p16__00179__l50 | 39 | 1.44 | 88.89% | 8 of 9 | 100.00% | 9 of 9 |
| ha1p16__00182__l50 | 40 | 1.45 | 77.78% | 7 of 9 | 100.00% | 9 of 9 |
| ha1p16__00257__l50 | 41 | 1.42 | 66.67% | 6 of 9 | 87.50% | 7 of 8 |
| ha1p__12601__l50 | 42 | 1.245 | 88.89% | 8 of 9 | 100.00% | 9 of 9 |
| ha1p__17147__l50 | 43 | 1.12 | 75.00% | 6 of 8 | 88.89% | 8 of 9 |
| ha1p__42350__l50 | 44 | 5.11 | 62.50% | 5 of 8 | 50.00% | 4 of 8 |
| ha1p__44897__l50 | 45 | 1.645 | 100.00% | 9 of 9 | 85.71% | 6 of 7 |
| ha1p__61253__l50 | 46 | 2.61 | 75.00% | 6 of 8 | 100.00% | 7 of 7 |
| CHR01P001005050 | 47 | 1.745 | 75.00% | 6 of 8 | 100.00% | 7 of 7 |
| CHR16P001157479 | 48 | — | — | — | — | — |
| ha1g__00681 | 49 | 1.68 | 44% | 4 of 9 | 100% | 9 of 9 |
| ha1g__01966 | 50 | 1.99 | 89% | 8 of 9 | 100% | 9 of 9 |
| ha1g__02153 | 51 | 1.51 | 56% | 5 of 9 | 100% | 9 of 9 |
| ha1g__02319 | 52 | 0.64 | 100% | 9 of 9 | 89% | 8 of 9 |

TABLE 13-continued

Sensitivity and Specificity of differentially methylated loci in bladder tumors relative to adjacent histological normal bladder tissue.

| Feature Name | Locus Number | Threshold | Sensitivity | Pos. of Total | Specificity | Neg. of Total |
|---|---|---|---|---|---|---|
| ha1g__02335 | 53 | 4.24 | 78% | 7 of 9 | 33% | 3 of 9 |
| ha1p16__00182 | 54 | 0.73 | 100% | 9 of 9 | 67% | 6 of 9 |
| ha1p16__00185 | 55 | 1.12 | 67% | 6 of 9 | 100% | 9 of 9 |
| ha1p16__00193 | 56 | 1.94 | 56% | 5 of 9 | 100% | 9 of 9 |
| ha1p16__00259 | 57 | 2.17 | 88% | 7 of 8 | 78% | 7 of 9 |
| ha1p__02799 | 58 | 2.35 | 56% | 5 of 9 | 100% | 9 of 9 |
| ha1p__03567 | 59 | 1.06 | 67% | 6 of 9 | 75% | 6 of 8 |
| ha1p__03671 | 60 | 1.15 | 89% | 8 of 9 | 89% | 8 of 9 |
| ha1p__05803 | 61 | 2.09 | 67% | 6 of 9 | 100% | 9 of 9 |
| ha1p__07131 | 62 | 3.52 | 78% | 7 of 9 | 89% | 8 of 9 |
| ha1p__07989 | 63 | 2.06 | 78% | 7 of 9 | 88% | 7 of 8 |
| ha1p__08588 | 64 | 3.96 | 67% | 6 of 9 | 100% | 9 of 9 |
| ha1p__09700 | 65 | 0.77 | 75% | 6 of 8 | 100% | 8 of 8 |
| ha1p__104458 | 66 | 3.43 | 56% | 5 of 9 | 100% | 9 of 9 |
| ha1p__105287 | 67 | 2.96 | 100% | 9 of 9 | 89% | 8 of 9 |
| ha1p__10702 | 68 | 3.06 | 67% | 6 of 9 | 100% | 8 of 8 |
| ha1p__108469 | 69 | 1.54 | 33% | 3 of 9 | 100% | 9 of 9 |
| ha1p__108849 | 70 | 3.42 | 67% | 6 of 9 | 100% | 9 of 9 |
| ha1p__11016 | 71 | 2.92 | 100% | 9 of 9 | 100% | 9 of 9 |
| ha1p__11023 | 72 | 2.91 | 56% | 5 of 9 | 100% | 9 of 9 |
| ha1p__12974 | 73 | 0.53 | 56% | 5 of 9 | 78% | 7 of 9 |
| ha1p__16027 | 74 | 2.2 | 44% | 4 of 9 | 89% | 8 of 9 |
| ha1p__16066 | 75 | 2.25 | 56% | 5 of 9 | 78% | 7 of 9 |
| ha1p__18911 | 76 | 2.77 | 44% | 4 of 9 | 100% | 8 of 8 |
| ha1p__19254 | 77 | 1.95 | 78% | 7 of 9 | 100% | 9 of 9 |
| ha1p__19853 | 78 | 0.79 | 78% | 7 of 9 | 89% | 8 of 9 |
| ha1p__22257 | 79 | 2.7 | 67% | 6 of 9 | 100% | 9 of 9 |
| ha1p__22519 | 80 | 1.41 | 89% | 8 of 9 | 78% | 7 of 9 |
| ha1p__31800 | 81 | 2.65 | 50% | 3 of 6 | 89% | 8 of 9 |
| ha1p__33290 | 82 | 2.62 | 89% | 8 of 9 | 100% | 9 of 9 |
| ha1p__37635 | 83 | 6 | 100% | 9 of 9 | 0% | 0 of 9 |
| ha1p__39189 | 84 | 0.78 | 100% | 9 of 9 | 78% | 7 of 9 |
| ha1p__39511 | 85 | 3.02 | 44% | 4 of 9 | 100% | 9 of 9 |
| ha1p__39752 | 86 | 2.51 | 56% | 5 of 9 | 100% | 9 of 9 |
| ha1p__60945 | 87 | 2 | 67% | 6 of 9 | 100% | 9 of 9 |
| ha1p__62183 | 88 | 4.11 | 22% | 2 of 9 | 100% | 9 of 9 |
| ha1p__69418 | 89 | 2.64 | 78% | 7 of 9 | 100% | 8 of 8 |
| ha1p__71224 | 90 | 1.83 | 89% | 8 of 9 | 100% | 9 of 9 |
| ha1p__74221 | 91 | 1.98 | 56% | 5 of 9 | 89% | 8 of 9 |
| ha1p__76289 | 92 | 1.11 | 78% | 7 of 9 | 100% | 9 of 9 |
| ha1p__81050 | 93 | 3.95 | 78% | 7 of 9 | 89% | 8 of 9 |
| ha1p__81674 | 94 | 1.82 | 67% | 6 of 9 | 100% | 9 of 9 |
| ha1p__86355 | 95 | 1.18 | 89% | 8 of 9 | 75% | 6 of 8 |
| ha1p__98491 | 96 | 3.99 | 33% | 3 of 9 | 100% | 9 of 9 |
| ha1p__99426 | 97 | 1.34 | 67% | 6 of 9 | 100% | 9 of 9 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) adjacent normal samples.
Neg. of Total: Number of negative adjacent normal samples relative to the total number of adjacent normal samples analyzed.

TABLE 14

Sensitivity and Specificity of differentially methylated loci in breast tumors relative to adjacent histological normal breast tissue.

| Feature Name | Locus Number | Threshold | Sensitivity | Pos. of Total | Specificity | Neg. of Total |
|---|---|---|---|---|---|---|
| CHR01P001976799 | 1 | 5.18 | 70.00% | 7 of 10 | 100.00% | 10 of 10 |
| CHR01P026794862 | 2 | 2.075 | 100.00% | 8 of 8 | 33.33% | 1 of 3 |
| CHR01P043164342 | 3 | 1.8 | 50.00% | 5 of 10 | 80.00% | 8 of 10 |
| CHR01P063154999 | 4 | 2.295 | 60.00% | 6 of 10 | 90.00% | 9 of 10 |
| CHR01P204123050 | 5 | 1.655 | 80.00% | 8 of 10 | 60.00% | 6 of 10 |
| CHR01P206905110 | 6 | 2.165 | 70.00% | 7 of 10 | 90.00% | 9 of 10 |
| CHR01P225608458 | 7 | 1.9 | 80.00% | 8 of 10 | 90.00% | 9 of 10 |
| CHR02P005061785 | 8 | 2.18 | 80.00% | 8 of 10 | 90.00% | 9 of 10 |
| CHR02P042255672 | 9 | 5.895 | 70.00% | 7 of 10 | 70.00% | 7 of 10 |
| CHR02P223364582 | 10 | 2.625 | 60.00% | 6 of 10 | 70.00% | 7 of 10 |

TABLE 14-continued

Sensitivity and Specificity of differentially methylated loci in breast tumors relative to adjacent histological normal breast tissue.

| Feature Name | Locus Number | Threshold | Sensitivity | Pos. of Total | Specificity | Neg. of Total |
|---|---|---|---|---|---|---|
| CHR03P027740753 | 11 | 1.62 | 70.00% | 7 of 10 | 100.00% | 10 of 10 |
| CHR03P052525960 | 12 | 2.4 | 50.00% | 5 of 10 | 100.00% | 10 of 10 |
| CHR03P069745999 | 13 | 0.775 | 40.00% | 4 of 10 | 100.00% | 10 of 10 |
| CHR05P059799713 | 14 | 1.43 | 10.00% | 1 of 10 | 100.00% | 9 of 9 |
| CHR05P059799813 | 15 | 0.765 | 66.67% | 6 of 9 | 55.56% | 5 of 9 |
| CHR05P177842690 | 16 | 1.29 | 70.00% | 7 of 10 | 80.00% | 8 of 10 |
| CHR06P010694062 | 17 | 3.46 | 70.00% | 7 of 10 | 90.00% | 9 of 10 |
| CHR06P026333318 | 18 | 1.155 | 50.00% | 5 of 10 | 100.00% | 10 of 10 |
| CHR08P102460854 | 19 | 0.615 | 100.00% | 10 of 10 | 40.00% | 4 of 10 |
| CHR08P102461254 | 20 | 0.525 | 100.00% | 10 of 10 | 50.00% | 5 of 10 |
| CHR08P102461554 | 21 | 0.695 | 100.00% | 10 of 10 | 40.00% | 4 of 10 |
| CHR09P000107988 | 22 | 1.97 | 40.00% | 4 of 10 | 80.00% | 8 of 10 |
| CHR09P021958839 | 23 | 2.805 | 20.00% | 2 of 10 | 100.00% | 10 of 10 |
| CHR09P131048752 | 24 | 2.22 | 90.00% | 9 of 10 | 90.00% | 9 of 10 |
| CHR10P118975684 | 25 | 2.695 | 40.00% | 4 of 10 | 100.00% | 10 of 10 |
| CHR11P021861414 | 26 | 3.98 | 70.00% | 7 of 10 | 100.00% | 10 of 10 |
| CHR12P004359362 | 27 | 1.91 | 50.00% | 5 of 10 | 80.00% | 8 of 10 |
| CHR12P016001231 | 28 | 1.515 | 70.00% | 7 of 10 | 62.50% | 5 of 8 |
| CHR14P018893344 | 29 | 2.585 | 80.00% | 8 of 10 | 100.00% | 10 of 10 |
| CHR14P093230340 | 30 | 3.66 | 30.00% | 3 of 10 | 100.00% | 10 of 10 |
| CHR16P000373719 | 31 | 1.16 | 33.33% | 3 of 9 | 88.89% | 8 of 9 |
| CHR16P066389027 | 32 | 0.935 | 60.00% | 6 of 10 | 90.00% | 9 of 10 |
| CHR16P083319654 | 33 | 1.635 | 80.00% | 8 of 10 | 90.00% | 9 of 10 |
| CHR18P019705147 | 34 | 3.435 | 50.00% | 5 of 10 | 90.00% | 9 of 10 |
| CHR19P018622408 | 35 | 2.595 | 80.00% | 8 of 10 | 100.00% | 10 of 10 |
| CHR19P051892823 | 36 | 3.53 | 100.00% | 4 of 4 | 100.00% | 8 of 8 |
| CHRXP013196410 | 37 | 1.63 | 66.67% | 6 of 9 | 88.89% | 8 of 9 |
| CHRXP013196870 | 38 | 1.71 | 60.00% | 6 of 10 | 100.00% | 9 of 9 |
| ha1p16__00179__l50 | 39 | 1.4 | 30.00% | 3 of 10 | 100.00% | 10 of 10 |
| ha1p16__00182__l50 | 40 | 0.99 | 30.00% | 3 of 10 | 100.00% | 10 of 10 |
| ha1p16__00257__l50 | 41 | 2.5 | 30.00% | 3 of 10 | 100.00% | 10 of 10 |
| ha1p__12601__l50 | 42 | 0.99 | 100.00% | 10 of 10 | 80.00% | 8 of 10 |
| ha1p__17147__l50 | 43 | 0.99 | 100.00% | 10 of 10 | 80.00% | 8 of 10 |
| ha1p__42350__l50 | 44 | 5.27 | 50.00% | 5 of 10 | 80.00% | 8 of 10 |
| ha1p__44897__l50 | 45 | 2.76 | 40.00% | 4 of 10 | 90.00% | 9 of 10 |
| ha1p__61253__l50 | 46 | 1.37 | 80.00% | 8 of 10 | 90.00% | 9 of 10 |
| CHR01P001005050 | 47 | 0.605 | 70.00% | 7 of 10 | 75.00% | 6 of 8 |
| CHR16P001157479 | 48 | — | — | — | — | — |
| ha1g__00681 | 49 | 1.66 | 90% | 9 of 10 | 100% | 10 of 10 |
| ha1g__01966 | 50 | 3.37 | 60% | 6 of 10 | 90% | 9 of 10 |
| ha1g__02153 | 51 | 2.72 | 50% | 5 of 10 | 90% | 9 of 10 |
| ha1g__02319 | 52 | 2.03 | 50% | 5 of 10 | 100% | 10 of 10 |
| ha1g__02335 | 53 | 2.4 | 90% | 9 of 10 | 90% | 9 of 10 |
| ha1p16__00182 | 54 | 1.55 | 60% | 6 of 10 | 50% | 5 of 10 |
| ha1p16__00185 | 55 | 1.65 | 60% | 6 of 10 | 90% | 9 of 10 |
| ha1p16__00193 | 56 | 2.89 | 60% | 6 of 10 | 80% | 8 of 10 |
| ha1p16__00259 | 57 | 5.08 | 20% | 2 of 10 | 100% | 10 of 10 |
| ha1p__02799 | 58 | 4.22 | 80% | 8 of 10 | 60% | 6 of 10 |
| ha1p__03567 | 59 | 1.46 | 100% | 10 of 10 | 50% | 3 of 6 |
| ha1p__03671 | 60 | 0.59 | 40% | 4 of 10 | 90% | 9 of 10 |
| ha1p__05803 | 61 | 2.97 | 67% | 4 of 6 | 86% | 6 of 7 |
| ha1p__07131 | 62 | 5.55 | 100% | 7 of 7 | 86% | 6 of 7 |
| ha1p__07989 | 63 | 2.18 | 100% | 9 of 9 | 88% | 7 of 8 |
| ha1p__08588 | 64 | 5.9 | 100% | 10 of 10 | 90% | 9 of 10 |
| ha1p__09700 | 65 | 0.72 | 44% | 4 of 9 | 89% | 8 of 9 |
| ha1p__104458 | 66 | 6 | 20% | 2 of 10 | 90% | 9 of 10 |
| ha1p__105287 | 67 | 0.82 | 40% | 4 of 10 | 80% | 8 of 10 |
| ha1p__10702 | 68 | 1.57 | 60% | 6 of 10 | 100% | 9 of 9 |
| ha1p__108469 | 69 | 1.77 | 78% | 7 of 9 | 90% | 9 of 10 |
| ha1p__108849 | 70 | 1.78 | 80% | 8 of 10 | 80% | 8 of 10 |
| ha1p__11016 | 71 | 3.69 | 90% | 9 of 10 | 90% | 9 of 10 |
| ha1p__11023 | 72 | 3.02 | 80% | 8 of 10 | 80% | 8 of 10 |
| ha1p__12974 | 73 | 0.94 | 60% | 6 of 10 | 63% | 5 of 8 |
| ha1p__16027 | 74 | 1.81 | 80% | 8 of 10 | 70% | 7 of 10 |
| ha1p__16066 | 75 | 2.33 | 70% | 7 of 10 | 90% | 9 of 10 |
| ha1p__18911 | 76 | 3.31 | 100% | 9 of 9 | 30% | 3 of 10 |
| ha1p__19254 | 77 | 3.66 | 100% | 10 of 10 | 90% | 9 of 10 |
| ha1p__19853 | 78 | 1.18 | 80% | 8 of 10 | 80% | 8 of 10 |
| ha1p__22257 | 79 | 3.55 | 50% | 5 of 10 | 100% | 10 of 10 |
| ha1p__22519 | 80 | 1.64 | 100% | 9 of 9 | 90% | 9 of 10 |
| ha1p__31800 | 81 | 3.68 | 60% | 6 of 10 | 100% | 10 of 10 |
| ha1p__33290 | 82 | 2.26 | 90% | 9 of 10 | 100% | 10 of 10 |
| ha1p__37635 | 83 | 5.41 | 100% | 10 of 10 | 0% | 0 of 10 |
| ha1p__39189 | 84 | 1.12 | 88% | 7 of 8 | 89% | 8 of 9 |

TABLE 14-continued

Sensitivity and Specificity of differentially methylated loci in breast tumors relative to adjacent histological normal breast tissue.

| Feature Name | Locus Number | Threshold | Sensitivity | Pos. of Total | Specificity | Neg. of Total |
|---|---|---|---|---|---|---|
| ha1p__39511 | 85 | 3.3 | 60% | 6 of 10 | 78% | 7 of 9 |
| ha1p__39752 | 86 | 3.99 | 30% | 3 of 10 | 100% | 10 of 10 |
| ha1p__60945 | 87 | 1.84 | 70% | 7 of 10 | 50% | 5 of 10 |
| ha1p__62183 | 88 | 4.05 | 90% | 9 of 10 | 90% | 9 of 10 |
| ha1p__69418 | 89 | 2.39 | 60% | 6 of 10 | 90% | 9 of 10 |
| ha1p__71224 | 90 | 2.01 | 50% | 5 of 10 | 90% | 9 of 10 |
| ha1p__74221 | 91 | 1.12 | 80% | 8 of 10 | 50% | 5 of 10 |
| ha1p__76289 | 92 | 1.12 | 89% | 8 of 9 | 86% | 6 of 7 |
| ha1p__81050 | 93 | 4.34 | 100% | 10 of 10 | 90% | 9 of 10 |
| ha1p__81674 | 94 | 1.9 | 90% | 9 of 10 | 100% | 8 of 8 |
| ha1p__86355 | 95 | 2.08 | 70% | 7 of 10 | 100% | 8 of 8 |
| ha1p__98491 | 96 | 4.17 | 70% | 7 of 10 | 80% | 8 of 10 |
| ha1p__99426 | 97 | 1.2 | 90% | 9 of 10 | 90% | 9 of 10 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) adjacent normal samples.
Neg. of Total: Number of negative adjacent normal samples relative to the total number of adjacent normal samples analyzed.

TABLE 15

Sensitivity and Specificity of differentially methylated loci in cervical tumors relative to adjacent histological normal cervical tissue.

| Feature Name | Locus Number | Threshold | Sensitivity | Pos. of Total | Specificity | Neg. of Total |
|---|---|---|---|---|---|---|
| CHR01P001976799 | 1 | 2.985 | 100.00% | 10 of 10 | 100.00% | 9 of 9 |
| CHR01P026794862 | 2 | 0.985 | 50.00% | 3 of 6 | 87.50% | 7 of 8 |
| CHR01P043164342 | 3 | 2.535 | 60.00% | 6 of 10 | 100.00% | 8 of 8 |
| CHR01P063154999 | 4 | 1.165 | 90.00% | 9 of 10 | 88.89% | 8 of 9 |
| CHR01P204123050 | 5 | 1.87 | 60.00% | 6 of 10 | 88.89% | 8 of 9 |
| CHR01P206905110 | 6 | 2.83 | 80.00% | 8 of 10 | 100.00% | 9 of 9 |
| CHR01P225608458 | 7 | 2 | 80.00% | 8 of 10 | 100.00% | 9 of 9 |
| CHR02P005061785 | 8 | 1.99 | 100.00% | 10 of 10 | 100.00% | 9 of 9 |
| CHR02P042255672 | 9 | 2.02 | 80.00% | 8 of 10 | 100.00% | 9 of 9 |
| CHR02P223364582 | 10 | 2.11 | 70.00% | 7 of 10 | 77.78% | 7 of 9 |
| CHR03P027740753 | 11 | 0.96 | 90.00% | 9 of 10 | 100.00% | 9 of 9 |
| CHR03P052525960 | 12 | 1.74 | 70.00% | 7 of 10 | 100.00% | 9 of 9 |
| CHR03P069745999 | 13 | 2.955 | 60.00% | 6 of 10 | 100.00% | 9 of 9 |
| CHR05P059799713 | 14 | 0.89 | 50.00% | 5 of 10 | 88.89% | 8 of 9 |
| CHR05P059799813 | 15 | 0.735 | 30.00% | 3 of 10 | 88.89% | 8 of 9 |
| CHR05P177842690 | 16 | 1.885 | 40.00% | 4 of 10 | 100.00% | 9 of 9 |
| CHR06P010694062 | 17 | 2.38 | 90.00% | 9 of 10 | 100.00% | 9 of 9 |
| CHR06P026333318 | 18 | 1.97 | 90.00% | 9 of 10 | 100.00% | 7 of 7 |
| CHR08P102460854 | 19 | 0.925 | 90.00% | 9 of 10 | 75.00% | 6 of 8 |
| CHR08P102461254 | 20 | 1.305 | 80.00% | 8 of 10 | 100.00% | 9 of 9 |
| CHR08P102461554 | 21 | 1.1 | 80.00% | 8 of 10 | 100.00% | 9 of 9 |
| CHR09P000107988 | 22 | 1.6 | 70.00% | 7 of 10 | 100.00% | 9 of 9 |
| CHR09P021958839 | 23 | 1.27 | 70.00% | 7 of 10 | 77.78% | 7 of 9 |
| CHR09P131048752 | 24 | 3.68 | 70.00% | 7 of 10 | 66.67% | 6 of 9 |
| CHR10P118975684 | 25 | 1.28 | 80.00% | 8 of 10 | 66.67% | 6 of 9 |
| CHR11P021861414 | 26 | 5.505 | 80.00% | 8 of 10 | 88.89% | 8 of 9 |
| CHR12P004359362 | 27 | 3.645 | 30.00% | 3 of 10 | 100.00% | 9 of 9 |
| CHR12P016001231 | 28 | 1.56 | 100.00% | 10 of 10 | 77.78% | 7 of 9 |
| CHR14P018893344 | 29 | 1.255 | 100.00% | 10 of 10 | 100.00% | 9 of 9 |
| CHR14P093230340 | 30 | 1.695 | 88.89% | 8 of 9 | 85.71% | 6 of 7 |
| CHR16P000373719 | 31 | 2.135 | 87.50% | 7 of 8 | 80.00% | 4 of 5 |
| CHR16P066389027 | 32 | 1.22 | 60.00% | 6 of 10 | 55.56% | 5 of 9 |
| CHR16P083319654 | 33 | 2.885 | 100.00% | 10 of 10 | 66.67% | 6 of 9 |
| CHR18P019705147 | 34 | 2.815 | 80.00% | 8 of 10 | 100.00% | 9 of 9 |
| CHR19P018622408 | 35 | 1.525 | 100.00% | 10 of 10 | 100.00% | 9 of 9 |
| CHR19P051892823 | 36 | 1.445 | 66.67% | 4 of 6 | 100.00% | 4 of 4 |
| CHRXP013196410 | 37 | 1.545 | 80.00% | 8 of 10 | 100.00% | 9 of 9 |
| CHRXP013196870 | 38 | 1.48 | 80.00% | 8 of 10 | 85.71% | 6 of 7 |
| ha1p16__00179__l50 | 39 | 1.555 | 66.67% | 6 of 9 | 87.50% | 7 of 8 |
| ha1p16__00182__l50 | 40 | 1.205 | 70.00% | 7 of 10 | 100.00% | 9 of 9 |
| ha1p16__00257__l50 | 41 | 0.705 | 70.00% | 7 of 10 | 77.78% | 7 of 9 |
| ha1p__12601__l50 | 42 | 2.245 | 100.00% | 10 of 10 | 100.00% | 9 of 9 |

TABLE 15-continued

Sensitivity and Specificity of differentially methylated loci in cervical tumors relative to adjacent histological normal cervical tissue.

| Feature Name | Locus Number | Threshold | Sensitivity | Pos. of Total | Specificity | Neg. of Total |
|---|---|---|---|---|---|---|
| ha1p_17147_l50 | 43 | 2.455 | 90.00% | 9 of 10 | 100.00% | 9 of 9 |
| ha1p_42350_l50 | 44 | 2.335 | 66.67% | 6 of 9 | 77.78% | 7 of 9 |
| ha1p_44897_l50 | 45 | 3.755 | 80.00% | 8 of 10 | 85.71% | 6 of 7 |
| ha1p_61253_l50 | 46 | 1.34 | 100.00% | 10 of 10 | 100.00% | 6 of 6 |
| CHR01P001005050 | 47 | 2.025 | 80.00% | 8 of 10 | 100.00% | 9 of 9 |
| CHR16P001157479 | 48 | 4.045 | 71.43% | 5 of 7 | 100.00% | 2 of 2 |
| ha1g_00681 | 49 | 0.91 | 80% | 8 of 10 | 100% | 9 of 9 |
| ha1g_01966 | 50 | 1.71 | 100% | 10 of 10 | 67% | 6 of 9 |
| ha1g_02153 | 51 | 1.41 | 100% | 10 of 10 | 100% | 9 of 9 |
| ha1g_02319 | 52 | 0.99 | 100% | 10 of 10 | 89% | 8 of 9 |
| ha1g_02335 | 53 | 4.96 | 60% | 6 of 10 | 67% | 6 of 9 |
| ha1p16_00182 | 54 | 1.13 | 80% | 8 of 10 | 89% | 8 of 9 |
| ha1p16_00185 | 55 | 0.96 | 80% | 8 of 10 | 100% | 9 of 9 |
| ha1p16_00193 | 56 | 1.74 | 80% | 8 of 10 | 89% | 8 of 9 |
| ha1p16_00259 | 57 | 1.84 | 90% | 9 of 10 | 89% | 8 of 9 |
| ha1p_02799 | 58 | 3.12 | 20% | 2 of 10 | 100% | 9 of 9 |
| ha1p_03567 | 59 | 1.89 | 100% | 10 of 10 | 78% | 7 of 9 |
| ha1p_03671 | 60 | 1.14 | 80% | 8 of 10 | 100% | 9 of 9 |
| ha1p_05803 | 61 | 1.3 | 100% | 10 of 10 | 89% | 8 of 9 |
| ha1p_07131 | 62 | 5.67 | 70% | 7 of 10 | 100% | 9 of 9 |
| ha1p_07989 | 63 | 4.72 | 89% | 8 of 9 | 75% | 6 of 8 |
| ha1p_08588 | 64 | 6 | 70% | 7 of 10 | 89% | 8 of 9 |
| ha1p_09700 | 65 | 0.59 | 70% | 7 of 10 | 89% | 8 of 9 |
| ha1p_104458 | 66 | 4.45 | 70% | 7 of 10 | 78% | 7 of 9 |
| ha1p_105287 | 67 | 2.56 | 70% | 7 of 10 | 100% | 9 of 9 |
| ha1p_10702 | 68 | 2.09 | 60% | 6 of 10 | 100% | 9 of 9 |
| ha1p_108469 | 69 | 1.27 | 100% | 10 of 10 | 44% | 4 of 9 |
| ha1p_108849 | 70 | 3.01 | 100% | 10 of 10 | 78% | 7 of 9 |
| ha1p_11016 | 71 | 3.18 | 100% | 10 of 10 | 56% | 5 of 9 |
| ha1p_11023 | 72 | 2.52 | 90% | 9 of 10 | 100% | 9 of 9 |
| ha1p_12974 | 73 | 0.6 | 50% | 5 of 10 | 89% | 8 of 9 |
| ha1p_16027 | 74 | 1.56 | 100% | 10 of 10 | 56% | 5 of 9 |
| ha1p_16066 | 75 | 2.15 | 60% | 6 of 10 | 88% | 7 of 8 |
| ha1p_18911 | 76 | 3.08 | 60% | 6 of 10 | 78% | 7 of 9 |
| ha1p_19254 | 77 | 4.53 | 90% | 9 of 10 | 100% | 8 of 8 |
| ha1p_19853 | 78 | 0.55 | 100% | 9 of 9 | 67% | 6 of 9 |
| ha1p_22257 | 79 | 2.35 | 60% | 6 of 10 | 78% | 7 of 9 |
| ha1p_22519 | 80 | 2.09 | 80% | 8 of 10 | 100% | 9 of 9 |
| ha1p_31800 | 81 | 2.88 | 90% | 9 of 10 | 89% | 8 of 9 |
| ha1p_33290 | 82 | 1.65 | 80% | 8 of 10 | 100% | 9 of 9 |
| ha1p_37635 | 83 | 6 | 10% | 1 of 10 | 100% | 9 of 9 |
| ha1p_39189 | 84 | 0.86 | 100% | 10 of 10 | 78% | 7 of 9 |
| ha1p_39511 | 85 | 3.18 | 63% | 5 of 8 | 89% | 8 of 9 |
| ha1p_39752 | 86 | 2.44 | 88% | 7 of 8 | 100% | 8 of 8 |
| ha1p_60945 | 87 | 1.44 | 80% | 8 of 10 | 67% | 6 of 9 |
| ha1p_62183 | 88 | 5.21 | 60% | 6 of 10 | 56% | 5 of 9 |
| ha1p_69418 | 89 | 3.61 | 100% | 10 of 10 | 78% | 7 of 9 |
| ha1p_71224 | 90 | 1.99 | 80% | 8 of 10 | 100% | 9 of 9 |
| ha1p_74221 | 91 | 1.61 | 89% | 8 of 9 | 100% | 8 of 8 |
| ha1p_76289 | 92 | 0.52 | 90% | 9 of 10 | 100% | 8 of 8 |
| ha1p_81050 | 93 | 6 | 50% | 5 of 10 | 100% | 9 of 9 |
| ha1p_81674 | 94 | 0.87 | 80% | 8 of 10 | 78% | 7 of 9 |
| ha1p_86355 | 95 | 1.56 | 60% | 6 of 10 | 89% | 8 of 9 |
| ha1p_98491 | 96 | 3.3 | 70% | 7 of 10 | 67% | 6 of 9 |
| ha1p_99426 | 97 | 0.76 | 90% | 9 of 10 | 100% | 9 of 9 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) adjacent normal samples.
Neg. of Total: Number of negative adjacent normal samples relative to the total number of adjacent normal samples analyzed.

TABLE 16

Sensitivity and Specificity of differentially methylated loci in colon tumors relative to adjacent histological normal colon tissue.

| Feature Name | Locus Number | Threshold | Sensitivity | Pos. of Total | Specificity | Neg. of Total |
|---|---|---|---|---|---|---|
| CHR01P001976799 | 1 | 5.86 | 80.00% | 8 of 10 | 90.00% | 9 of 10 |
| CHR01P026794862 | 2 | 0.88 | 50.00% | 4 of 8 | 87.50% | 7 of 8 |
| CHR01P043164342 | 3 | 1.78 | 80.00% | 8 of 10 | 60.00% | 6 of 10 |
| CHR01P063154999 | 4 | 1.14 | 80.00% | 8 of 10 | 90.00% | 9 of 10 |
| CHR01P204123050 | 5 | 1.655 | 40.00% | 4 of 10 | 100.00% | 10 of 10 |
| CHR01P206905110 | 6 | 1.63 | 70.00% | 7 of 10 | 80.00% | 8 of 10 |
| CHR01P225608458 | 7 | 1.97 | 80.00% | 8 of 10 | 90.00% | 9 of 10 |
| CHR02P005061785 | 8 | 5.51 | 50.00% | 5 of 10 | 80.00% | 8 of 10 |
| CHR02P042255672 | 9 | 2.8 | 80.00% | 8 of 10 | 100.00% | 10 of 10 |
| CHR02P223364582 | 10 | 2 | 80.00% | 8 of 10 | 90.00% | 9 of 10 |
| CHR03P027740753 | 11 | 1.26 | 90.00% | 9 of 10 | 80.00% | 8 of 10 |
| CHR03P052525960 | 12 | 2.825 | 100.00% | 10 of 10 | 80.00% | 8 of 10 |
| CHR03P069745999 | 13 | 3.6 | 70.00% | 7 of 10 | 90.00% | 9 of 10 |
| CHR05P059799713 | 14 | 1.025 | 50.00% | 5 of 10 | 80.00% | 8 of 10 |
| CHR05P059799813 | 15 | 0.89 | 40.00% | 4 of 10 | 80.00% | 8 of 10 |
| CHR05P177842690 | 16 | 3.58 | 90.00% | 9 of 10 | 20.00% | 2 of 10 |
| CHR06P010694062 | 17 | 3.055 | 90.00% | 9 of 10 | 90.00% | 9 of 10 |
| CHR06P026333318 | 18 | 3.175 | 90.00% | 9 of 10 | 90.00% | 9 of 10 |
| CHR08P102460854 | 19 | 0.825 | 90.00% | 9 of 10 | 70.00% | 7 of 10 |
| CHR08P102461254 | 20 | 0.69 | 80.00% | 8 of 10 | 80.00% | 8 of 10 |
| CHR08P102461554 | 21 | 1.015 | 90.00% | 9 of 10 | 70.00% | 7 of 10 |
| CHR09P000107988 | 22 | 0.985 | 90.00% | 9 of 10 | 80.00% | 8 of 10 |
| CHR09P021958839 | 23 | 1.46 | 90.00% | 9 of 10 | 100.00% | 10 of 10 |
| CHR09P131048752 | 24 | 3.695 | 70.00% | 7 of 10 | 100.00% | 10 of 10 |
| CHR10P118975684 | 25 | 1.41 | 80.00% | 8 of 10 | 90.00% | 9 of 10 |
| CHR11P021861414 | 26 | 3.79 | 90.00% | 9 of 10 | 90.00% | 9 of 10 |
| CHR12P004359362 | 27 | 3.51 | 50.00% | 5 of 10 | 80.00% | 8 of 10 |
| CHR12P016001231 | 28 | 1.295 | 40.00% | 4 of 10 | 90.00% | 9 of 10 |
| CHR14P018893344 | 29 | 2.805 | 80.00% | 8 of 10 | 90.00% | 9 of 10 |
| CHR14P093230340 | 30 | 1.66 | 90.00% | 9 of 10 | 70.00% | 7 of 10 |
| CHR16P000373719 | 31 | 1.525 | 40.00% | 2 of 5 | 87.50% | 7 of 8 |
| CHR16P066389027 | 32 | 0.655 | 90.00% | 9 of 10 | 80.00% | 8 of 10 |
| CHR16P083319654 | 33 | 1.79 | 90.00% | 9 of 10 | 60.00% | 6 of 10 |
| CHR18P019705147 | 34 | 2.01 | 80.00% | 8 of 10 | 60.00% | 6 of 10 |
| CHR19P018622408 | 35 | 3.015 | 60.00% | 6 of 10 | 100.00% | 10 of 10 |
| CHR19P051892823 | 36 | 0.6 | 57.14% | 4 of 7 | 100.00% | 7 of 7 |
| CHRXP013196410 | 37 | 2.99 | 60.00% | 6 of 10 | 100.00% | 10 of 10 |
| CHRXP013196870 | 38 | 2.92 | 60.00% | 6 of 10 | 100.00% | 9 of 9 |
| ha1p16__00179__l50 | 39 | 1.425 | 80.00% | 8 of 10 | 90.00% | 9 of 10 |
| ha1p16__00182__l50 | 40 | 1.22 | 80.00% | 8 of 10 | 90.00% | 9 of 10 |
| ha1p16__00257__l50 | 41 | 1.085 | 90.00% | 9 of 10 | 90.00% | 9 of 10 |
| ha1p__12601__l50 | 42 | 0.68 | 80.00% | 8 of 10 | 80.00% | 8 of 10 |
| ha1p__17147__l50 | 43 | 1.025 | 90.00% | 9 of 10 | 60.00% | 6 of 10 |
| ha1p__42350__l50 | 44 | 3.865 | 80.00% | 8 of 10 | 55.56% | 5 of 9 |
| ha1p__44897__l50 | 45 | 3.045 | 60.00% | 6 of 10 | 100.00% | 10 of 10 |
| ha1p__61253__l50 | 46 | 1.88 | 100.00% | 10 of 10 | 90.00% | 9 of 10 |
| CHR01P001005050 | 47 | 1.03 | 70.00% | 7 of 10 | 66.67% | 6 of 9 |
| CHR16P001157479 | 48 | 2.055 | 50.00% | 4 of 8 | 100.00% | 9 of 9 |
| ha1g__00681 | 49 | 1.61 | 70% | 7 of 10 | 90% | 9 of 10 |
| ha1g__01966 | 50 | 1.76 | 100% | 10 of 10 | 90% | 9 of 10 |
| ha1g__02153 | 51 | 1.51 | 80% | 8 of 10 | 90% | 9 of 10 |
| ha1g__02319 | 52 | 0.53 | 80% | 8 of 10 | 90% | 9 of 10 |
| ha1g__02335 | 53 | 1.63 | 90% | 9 of 10 | 80% | 8 of 10 |
| ha1p16__00182 | 54 | 1.17 | 90% | 9 of 10 | 90% | 9 of 10 |
| ha1p16__00185 | 55 | 1.08 | 90% | 9 of 10 | 80% | 8 of 10 |
| ha1p16__00193 | 56 | 1.79 | 90% | 9 of 10 | 80% | 8 of 10 |
| ha1p16__00259 | 57 | 2.89 | 90% | 9 of 10 | 100% | 10 of 10 |
| ha1p__02799 | 58 | 4.6 | 50% | 5 of 10 | 100% | 9 of 9 |
| ha1p__03567 | 59 | 0.78 | 70% | 7 of 10 | 30% | 3 of 10 |
| ha1p__03671 | 60 | 2.03 | 50% | 5 of 10 | 89% | 8 of 9 |
| ha1p__05803 | 61 | 2.22 | 80% | 8 of 10 | 90% | 9 of 10 |
| ha1p__07131 | 62 | 4.26 | 100% | 10 of 10 | 80% | 8 of 10 |
| ha1p__07989 | 63 | 2.48 | 67% | 6 of 9 | 100% | 10 of 10 |
| ha1p__08588 | 64 | 4.17 | 90% | 9 of 10 | 70% | 7 of 10 |
| ha1p__09700 | 65 | 0.66 | 33% | 3 of 9 | 100% | 9 of 9 |
| ha1p__104458 | 66 | 4.08 | 80% | 8 of 10 | 90% | 9 of 10 |
| ha1p__105287 | 67 | 1.61 | 70% | 7 of 10 | 80% | 8 of 10 |
| ha1p__10702 | 68 | 1.14 | 50% | 5 of 10 | 80% | 8 of 10 |
| ha1p__108469 | 69 | 1.72 | 90% | 9 of 10 | 80% | 8 of 10 |
| ha1p__108849 | 70 | 3.63 | 80% | 8 of 10 | 100% | 9 of 9 |
| ha1p__11016 | 71 | 2.28 | 90% | 9 of 10 | 90% | 9 of 10 |
| ha1p__11023 | 72 | 2.04 | 90% | 9 of 10 | 80% | 8 of 10 |
| ha1p__12974 | 73 | 0.68 | 30% | 3 of 10 | 100% | 10 of 10 |
| ha1p__16027 | 74 | 2.03 | 50% | 5 of 10 | 90% | 9 of 10 |

TABLE 16-continued

Sensitivity and Specificity of differentially methylated loci in colon tumors relative to adjacent histological normal colon tissue.

| Feature Name | Locus Number | Threshold | Sensitivity | Pos. of Total | Specificity | Neg. of Total |
|---|---|---|---|---|---|---|
| ha1p__16066 | 75 | 2.09 | 80% | 8 of 10 | 60% | 6 of 10 |
| ha1p__18911 | 76 | 2.52 | 78% | 7 of 9 | 90% | 9 of 10 |
| ha1p__19254 | 77 | 3.07 | 100% | 10 of 10 | 80% | 8 of 10 |
| ha1p__19853 | 78 | 1.74 | 50% | 5 of 10 | 100% | 10 of 10 |
| ha1p__22257 | 79 | 0.96 | 50% | 5 of 10 | 80% | 8 of 10 |
| ha1p__22519 | 80 | 2.62 | 70% | 7 of 10 | 90% | 9 of 10 |
| ha1p__31800 | 81 | 3.8 | 60% | 6 of 10 | 100% | 10 of 10 |
| ha1p__33290 | 82 | 2.56 | 90% | 9 of 10 | 90% | 9 of 10 |
| ha1p__37635 | 83 | 6 | 100% | 10 of 10 | 0% | 0 of 10 |
| ha1p__39189 | 84 | 1.29 | 100% | 9 of 9 | 80% | 8 of 10 |
| ha1p__39511 | 85 | 1.99 | 70% | 7 of 10 | 90% | 9 of 10 |
| ha1p__39752 | 86 | 3.01 | 40% | 4 of 10 | 90% | 9 of 10 |
| ha1p__60945 | 87 | 1.11 | 100% | 10 of 10 | 70% | 7 of 10 |
| ha1p__62183 | 88 | 2.58 | 60% | 6 of 10 | 80% | 8 of 10 |
| ha1p__69418 | 89 | 1.68 | 70% | 7 of 10 | 80% | 8 of 10 |
| ha1p__71224 | 90 | 2.42 | 70% | 7 of 10 | 90% | 9 of 10 |
| ha1p__74221 | 91 | 0.98 | 88% | 7 of 8 | 67% | 6 of 9 |
| ha1p__76289 | 92 | 1.84 | 80% | 8 of 10 | 100% | 9 of 9 |
| ha1p__81050 | 93 | 5.74 | 60% | 6 of 10 | 90% | 9 of 10 |
| ha1p__81674 | 94 | 2.3 | 60% | 6 of 10 | 100% | 10 of 10 |
| ha1p__86355 | 95 | 0.67 | 50% | 5 of 10 | 80% | 8 of 10 |
| ha1p__98491 | 96 | 1.63 | 50% | 5 of 10 | 80% | 8 of 10 |
| ha1p__99426 | 97 | 2.21 | 50% | 5 of 10 | 100% | 10 of 10 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) adjacent normal samples.
Neg. of Total: Number of negative adjacent normal samples relative to the total number of adjacent normal samples analyzed.

TABLE 17

Sensitivity and Specificity of differentially methylated loci in endometrial tumors relative to adjacent histological normal endometrial tissue.

| Feature Name | Locus Number | Threshold | Sensitivity | Pos. of Total | Specificity | Neg. of Total |
|---|---|---|---|---|---|---|
| CHR01P001976799 | 1 | 2.95 | 78.57% | 11 of 14 | 100.00% | 9 of 9 |
| CHR01P026794862 | 2 | 1.565 | 50.00% | 2 of 4 | 100.00% | 1 of 1 |
| CHR01P043164342 | 3 | 3.105 | 92.86% | 13 of 14 | 100.00% | 9 of 9 |
| CHR01P063154999 | 4 | 0.705 | 85.71% | 12 of 14 | 77.78% | 7 of 9 |
| CHR01P204123050 | 5 | 2.55 | 40.00% | 4 of 10 | 100.00% | 5 of 5 |
| CHR01P206905110 | 6 | 3.385 | 92.86% | 13 of 14 | 100.00% | 9 of 9 |
| CHR01P225608458 | 7 | 2.025 | 57.14% | 8 of 14 | 88.89% | 8 of 9 |
| CHR02P005061785 | 8 | 1.17 | 92.86% | 13 of 14 | 88.89% | 8 of 9 |
| CHR02P042255672 | 9 | 1.175 | 78.57% | 11 of 14 | 100.00% | 9 of 9 |
| CHR02P223364582 | 10 | 2.145 | 100.00% | 14 of 14 | 66.67% | 6 of 9 |
| CHR03P027740753 | 11 | 0.985 | 85.71% | 12 of 14 | 100.00% | 9 of 9 |
| CHR03P052525960 | 12 | 1.84 | 71.43% | 10 of 14 | 88.89% | 8 of 9 |
| CHR03P069745999 | 13 | 1.25 | 85.71% | 12 of 14 | 44.44% | 4 of 9 |
| CHR05P059799713 | 14 | 1.285 | 71.43% | 10 of 14 | 88.89% | 8 of 9 |
| CHR05P059799813 | 15 | 1.28 | 78.57% | 11 of 14 | 77.78% | 7 of 9 |
| CHR05P177842690 | 16 | 1.72 | 78.57% | 11 of 14 | 88.89% | 8 of 9 |
| CHR06P010694062 | 17 | 3.215 | 50.00% | 7 of 14 | 100.00% | 9 of 9 |
| CHR06P026333318 | 18 | 1.895 | 92.86% | 13 of 14 | 100.00% | 9 of 9 |
| CHR08P102460854 | 19 | 1.44 | 92.86% | 13 of 14 | 88.89% | 8 of 9 |
| CHR08P102461254 | 20 | 1.635 | 100.00% | 14 of 14 | 100.00% | 9 of 9 |
| CHR08P102461554 | 21 | 1.97 | 100.00% | 14 of 14 | 88.89% | 8 of 9 |
| CHR09P000107988 | 22 | 1.52 | 92.86% | 13 of 14 | 88.89% | 8 of 9 |
| CHR09P021958839 | 23 | 1.27 | 100.00% | 14 of 14 | 66.67% | 6 of 9 |
| CHR09P131048752 | 24 | 2.72 | 71.43% | 10 of 14 | 77.78% | 7 of 9 |
| CHR10P118975684 | 25 | 0.505 | 35.71% | 5 of 14 | 88.89% | 8 of 9 |
| CHR11P021861414 | 26 | 5.925 | 78.57% | 11 of 14 | 100.00% | 9 of 9 |
| CHR12P004359362 | 27 | 2.28 | 92.86% | 13 of 14 | 100.00% | 9 of 9 |
| CHR12P016001231 | 28 | 1.635 | 100.00% | 14 of 14 | 100.00% | 9 of 9 |
| CHR14P018893344 | 29 | 1.565 | 71.43% | 10 of 14 | 100.00% | 9 of 9 |
| CHR14P093230340 | 30 | 2.235 | 78.57% | 11 of 14 | 77.78% | 7 of 9 |
| CHR16P000373719 | 31 | 2.88 | 100.00% | 10 of 10 | 80.00% | 4 of 5 |
| CHR16P066389027 | 32 | 1.325 | 85.71% | 12 of 14 | 50.00% | 4 of 8 |

TABLE 17-continued

Sensitivity and Specificity of differentially methylated loci in endometrial tumors relative to adjacent histological normal endometrial tissue.

| Feature Name | Locus Number | Threshold | Sensitivity | Pos. of Total | Specificity | Neg. of Total |
|---|---|---|---|---|---|---|
| CHR16P083319654 | 33 | 2.49 | 100.00% | 14 of 14 | 88.89% | 8 of 9 |
| CHR18P019705147 | 34 | 3.36 | 92.86% | 13 of 14 | 100.00% | 9 of 9 |
| CHR19P018622408 | 35 | 1.97 | 71.43% | 10 of 14 | 100.00% | 9 of 9 |
| CHR19P051892823 | 36 | 1.11 | 85.71% | 6 of 7 | 100.00% | 6 of 6 |
| CHRXP013196410 | 37 | 1.205 | 92.31% | 12 of 13 | 77.78% | 7 of 9 |
| CHRXP013196870 | 38 | 1.32 | 78.57% | 11 of 14 | 71.43% | 5 of 7 |
| ha1p16__00179_l50 | 39 | 1.325 | 100.00% | 14 of 14 | 77.78% | 7 of 9 |
| ha1p16__00182_l50 | 40 | 0.985 | 92.86% | 13 of 14 | 66.67% | 6 of 9 |
| ha1p16__00257_l50 | 41 | 1.06 | 85.71% | 12 of 14 | 77.78% | 7 of 9 |
| ha1p__12601_l50 | 42 | 3.35 | 100.00% | 14 of 14 | 88.89% | 8 of 9 |
| ha1p__17147_l50 | 43 | 2.68 | 100.00% | 14 of 14 | 100.00% | 9 of 9 |
| ha1p__42350_l50 | 44 | 2.175 | 38.46% | 5 of 13 | 100.00% | 7 of 7 |
| ha1p__44897_l50 | 45 | 4.065 | 78.57% | 11 of 14 | 44.44% | 4 of 9 |
| ha1p__61253_l50 | 46 | 1.115 | 100.00% | 6 of 6 | 50.00% | 1 of 2 |
| CHR01P001005050 | 47 | 1.75 | 80.00% | 8 of 10 | 100.00% | 7 of 7 |
| CHR16P001157479 | 48 | — | — | — | — | — |
| ha1g__00681 | 49 | 1.74 | 50% | 7 of 14 | 100% | 9 of 9 |
| ha1g__01966 | 50 | 2.26 | 71% | 10 of 14 | 78% | 7 of 9 |
| ha1g__02153 | 51 | 0.68 | 93% | 13 of 14 | 78% | 7 of 9 |
| ha1g__02319 | 52 | 0.62 | 36% | 5 of 14 | 100% | 9 of 9 |
| ha1g__02335 | 53 | 1.77 | 69% | 9 of 13 | 44% | 4 of 9 |
| ha1p16__00182 | 54 | 0.89 | 79% | 11 of 14 | 78% | 7 of 9 |
| ha1p16__00185 | 55 | 0.86 | 71% | 10 of 14 | 89% | 8 of 9 |
| ha1p16__00193 | 56 | 1.67 | 85% | 11 of 13 | 78% | 7 of 9 |
| ha1p16__00259 | 57 | 1.94 | 100% | 14 of 14 | 78% | 7 of 9 |
| ha1p__02799 | 58 | 4.32 | 93% | 13 of 14 | 78% | 7 of 9 |
| ha1p__03567 | 59 | 1.79 | 79% | 11 of 14 | 89% | 8 of 9 |
| ha1p__03671 | 60 | 0.83 | 64% | 9 of 14 | 78% | 7 of 9 |
| ha1p__05803 | 61 | 0.66 | 93% | 13 of 14 | 89% | 8 of 9 |
| ha1p__07131 | 62 | 6 | 86% | 12 of 14 | 100% | 9 of 9 |
| ha1p__07989 | 63 | 3.79 | 36% | 5 of 14 | 100% | 9 of 9 |
| ha1p__08588 | 64 | 6 | 93% | 13 of 14 | 100% | 9 of 9 |
| ha1p__09700 | 65 | 0.82 | 100% | 13 of 13 | 25% | 2 of 8 |
| ha1p__104458 | 66 | 3.93 | 29% | 4 of 14 | 100% | 9 of 9 |
| ha1p__105287 | 67 | 2.99 | 100% | 14 of 14 | 100% | 9 of 9 |
| ha1p__10702 | 68 | 0.75 | 50% | 7 of 14 | 100% | 8 of 8 |
| ha1p__108469 | 69 | 1.43 | 64% | 9 of 14 | 67% | 6 of 9 |
| ha1p__108849 | 70 | 2.92 | 79% | 11 of 14 | 89% | 8 of 9 |
| ha1p__11016 | 71 | 4.13 | 50% | 7 of 14 | 100% | 9 of 9 |
| ha1p__11023 | 72 | 1.61 | 64% | 9 of 14 | 100% | 9 of 9 |
| ha1p__12974 | 73 | 0.51 | 0% | 0 of 14 | 89% | 8 of 9 |
| ha1p__16027 | 74 | 1.93 | 64% | 9 of 14 | 56% | 5 of 9 |
| ha1p__16066 | 75 | 0.51 | 79% | 11 of 14 | 78% | 7 of 9 |
| ha1p__18911 | 76 | 2.53 | 43% | 6 of 14 | 89% | 8 of 9 |
| ha1p__19254 | 77 | 5.53 | 79% | 11 of 14 | 100% | 9 of 9 |
| ha1p__19853 | 78 | 0.85 | 79% | 11 of 14 | 89% | 8 of 9 |
| ha1p__22257 | 79 | 2.22 | 43% | 6 of 14 | 100% | 9 of 9 |
| ha1p__22519 | 80 | 2.02 | 64% | 9 of 14 | 100% | 9 of 9 |
| ha1p__31800 | 81 | 3.52 | 57% | 8 of 14 | 89% | 8 of 9 |
| ha1p__33290 | 82 | 1.24 | 71% | 10 of 14 | 89% | 8 of 9 |
| ha1p__37635 | 83 | 6 | 7% | 1 of 14 | 100% | 9 of 9 |
| ha1p__39189 | 84 | 0.63 | 86% | 12 of 14 | 89% | 8 of 9 |
| ha1p__39511 | 85 | 3.91 | 71% | 10 of 14 | 56% | 5 of 9 |
| ha1p__39752 | 86 | 1.66 | 86% | 12 of 14 | 78% | 7 of 9 |
| ha1p__60945 | 87 | 0.86 | 86% | 12 of 14 | 33% | 3 of 9 |
| ha1p__62183 | 88 | 4.01 | 71% | 10 of 14 | 100% | 9 of 9 |
| ha1p__69418 | 89 | 2.53 | 50% | 7 of 14 | 100% | 9 of 9 |
| ha1p__71224 | 90 | 1.46 | 71% | 10 of 14 | 78% | 7 of 9 |
| ha1p__74221 | 91 | 0.88 | 85% | 11 of 13 | 63% | 5 of 8 |
| ha1p__76289 | 92 | 0.74 | 71% | 10 of 14 | 78% | 7 of 9 |
| ha1p__81050 | 93 | 5.92 | 79% | 11 of 14 | 100% | 9 of 9 |
| ha1p__81674 | 94 | 0.82 | 86% | 12 of 14 | 89% | 8 of 9 |
| ha1p__86355 | 95 | 1.19 | 79% | 11 of 14 | 75% | 6 of 8 |
| ha1p__98491 | 96 | 2.11 | 62% | 8 of 13 | 100% | 9 of 9 |
| ha1p__99426 | 97 | 0.66 | 79% | 11 of 14 | 89% | 8 of 9 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) adjacent normal samples.
Neg. of Total: Number of negative adjacent normal samples relative to the total number of adjacent normal samples analyzed.

TABLE 18

Sensitivity and Specificity of differentially methylated loci in esophageal tumors relative to adjacent histological normal esophageal tissue.

| Feature Name | Locus Number | Threshold | Sensitivity | Pos. of Total | Specificity | Neg. of Total |
|---|---|---|---|---|---|---|
| CHR01P001976799 | 1 | 6 | 100.00% | 9 of 9 | 0.00% | 0 of 10 |
| CHR01P026794862 | 2 | 1.075 | 12.50% | 1 of 8 | 100.00% | 6 of 6 |
| CHR01P043164342 | 3 | 5.84 | 66.67% | 6 of 9 | 100.00% | 10 of 10 |
| CHR01P063154999 | 4 | 1.02 | 100.00% | 9 of 9 | 50.00% | 5 of 10 |
| CHR01P204123050 | 5 | 1.515 | 62.50% | 5 of 8 | 77.78% | 7 of 9 |
| CHR01P206905110 | 6 | 1.935 | 88.89% | 8 of 9 | 66.67% | 6 of 9 |
| CHR01P225608458 | 7 | 1.52 | 100.00% | 9 of 9 | 70.00% | 7 of 10 |
| CHR02P005061785 | 8 | 3.345 | 55.56% | 5 of 9 | 80.00% | 8 of 10 |
| CHR02P042255672 | 9 | 3.095 | 88.89% | 8 of 9 | 70.00% | 7 of 10 |
| CHR02P223364582 | 10 | 1.765 | 88.89% | 8 of 9 | 80.00% | 8 of 10 |
| CHR03P027740753 | 11 | 0.97 | 100.00% | 9 of 9 | 80.00% | 8 of 10 |
| CHR03P052525960 | 12 | 1.93 | 55.56% | 5 of 9 | 90.00% | 9 of 10 |
| CHR03P069745999 | 13 | 3.435 | 77.78% | 7 of 9 | 80.00% | 8 of 10 |
| CHR05P059799713 | 14 | 1.38 | 77.78% | 7 of 9 | 70.00% | 7 of 10 |
| CHR05P059799813 | 15 | 1.57 | 55.56% | 5 of 9 | 90.00% | 9 of 10 |
| CHR05P177842690 | 16 | 2.435 | 62.50% | 5 of 8 | 55.56% | 5 of 9 |
| CHR06P010694062 | 17 | 2.07 | 77.78% | 7 of 9 | 77.78% | 7 of 9 |
| CHR06P026333318 | 18 | 1.34 | 88.89% | 8 of 9 | 60.00% | 6 of 10 |
| CHR08P102460854 | 19 | 0.555 | 66.67% | 6 of 9 | 60.00% | 6 of 10 |
| CHR08P102461254 | 20 | 0.86 | 62.50% | 5 of 8 | 70.00% | 7 of 10 |
| CHR08P102461554 | 21 | 0.905 | 88.89% | 8 of 9 | 40.00% | 4 of 10 |
| CHR09P000107988 | 22 | 1.025 | 100.00% | 9 of 9 | 60.00% | 6 of 10 |
| CHR09P021958839 | 23 | 0.965 | 100.00% | 9 of 9 | 40.00% | 4 of 10 |
| CHR09P131048752 | 24 | 3.61 | 77.78% | 7 of 9 | 90.00% | 9 of 10 |
| CHR10P118975684 | 25 | 1.455 | 66.67% | 6 of 9 | 100.00% | 10 of 10 |
| CHR11P021861414 | 26 | 4.49 | 100.00% | 9 of 9 | 80.00% | 8 of 10 |
| CHR12P004359362 | 27 | 2.085 | 66.67% | 6 of 9 | 90.00% | 9 of 10 |
| CHR12P016001231 | 28 | 0.855 | 50.00% | 4 of 8 | 90.00% | 9 of 10 |
| CHR14P018893344 | 29 | 2.14 | 100.00% | 9 of 9 | 90.00% | 9 of 10 |
| CHR14P093230340 | 30 | 2.035 | 100.00% | 9 of 9 | 90.00% | 9 of 10 |
| CHR16P000373719 | 31 | 0.83 | 87.50% | 7 of 8 | 66.67% | 6 of 9 |
| CHR16P066389027 | 32 | 0.75 | 100.00% | 9 of 9 | 11.11% | 1 of 9 |
| CHR16P083319654 | 33 | 2.145 | 55.56% | 5 of 9 | 90.00% | 9 of 10 |
| CHR18P019705147 | 34 | 2.245 | 88.89% | 8 of 9 | 50.00% | 4 of 8 |
| CHR19P018622408 | 35 | 1.78 | 100.00% | 9 of 9 | 60.00% | 6 of 10 |
| CHR19P051892823 | 36 | 2.295 | 25.00% | 1 of 4 | 100.00% | 5 of 5 |
| CHRXP013196410 | 37 | 1.615 | 100.00% | 9 of 9 | 40.00% | 4 of 10 |
| CHRXP013196870 | 38 | 1.945 | 88.89% | 8 of 9 | 50.00% | 5 of 10 |
| ha1p16__00179__l50 | 39 | 1.405 | 44.44% | 4 of 9 | 90.00% | 9 of 10 |
| ha1p16__00182__l50 | 40 | 0.995 | 66.67% | 6 of 9 | 77.78% | 7 of 9 |
| ha1p16__00257__l50 | 41 | 0.8 | 88.89% | 8 of 9 | 40.00% | 4 of 10 |
| ha1p__12601__l50 | 42 | 1.125 | 88.89% | 8 of 9 | 60.00% | 6 of 10 |
| ha1p__17147__l50 | 43 | 1.025 | 66.67% | 6 of 9 | 80.00% | 8 of 10 |
| ha1p__42350__l50 | 44 | 2.885 | 100.00% | 8 of 8 | 88.89% | 8 of 9 |
| ha1p__44897__l50 | 45 | 1.715 | 100.00% | 9 of 9 | 50.00% | 5 of 10 |
| ha1p__61253__l50 | 46 | 1.57 | 77.78% | 7 of 9 | 88.89% | 8 of 9 |
| CHR01P001005050 | 47 | 1.57 | 55.56% | 5 of 9 | 66.67% | 6 of 9 |
| CHR16P001157479 | 48 | 4.79 | 100.00% | 1 of 1 | 66.67% | 2 of 3 |
| ha1g__00681 | 49 | 0.69 | 89% | 8 of 9 | 80% | 8 of 10 |
| ha1g__01966 | 50 | 1.74 | 100% | 9 of 9 | 70% | 7 of 10 |
| ha1g__02153 | 51 | 1.42 | 78% | 7 of 9 | 80% | 8 of 10 |
| ha1g__02319 | 52 | 1.01 | 89% | 8 of 9 | 80% | 8 of 10 |
| ha1g__02335 | 53 | 3.54 | 89% | 8 of 9 | 40% | 4 of 10 |
| ha1p16__00182 | 54 | 0.78 | 89% | 8 of 9 | 70% | 7 of 10 |
| ha1p16__00185 | 55 | 0.85 | 89% | 8 of 9 | 50% | 5 of 10 |
| ha1p16__00193 | 56 | 1.45 | 89% | 8 of 9 | 50% | 5 of 10 |
| ha1p16__00259 | 57 | 2.28 | 50% | 4 of 8 | 80% | 8 of 10 |
| ha1p__02799 | 58 | 2.63 | 56% | 5 of 9 | 100% | 10 of 10 |
| ha1p__03567 | 59 | 1.09 | 78% | 7 of 9 | 80% | 8 of 10 |
| ha1p__03671 | 60 | 0.91 | 100% | 9 of 9 | 90% | 9 of 10 |
| ha1p__05803 | 61 | 1.37 | 100% | 9 of 9 | 90% | 9 of 10 |
| ha1p__07131 | 62 | 5.25 | 100% | 9 of 9 | 80% | 8 of 10 |
| ha1p__07989 | 63 | 2.79 | 83% | 5 of 6 | 80% | 8 of 10 |
| ha1p__08588 | 64 | 5.89 | 89% | 8 of 9 | 70% | 7 of 10 |
| ha1p__09700 | 65 | — | — | — | — | — |
| ha1p__104458 | 66 | 3.23 | 78% | 7 of 9 | 70% | 7 of 10 |
| ha1p__105287 | 67 | 1.49 | 56% | 5 of 9 | 90% | 9 of 10 |
| ha1p__10702 | 68 | 0.68 | 56% | 5 of 9 | 100% | 10 of 10 |
| ha1p__108469 | 69 | 1.7 | 33% | 3 of 9 | 100% | 9 of 9 |
| ha1p__108849 | 70 | 2.84 | 89% | 8 of 9 | 70% | 7 of 10 |
| ha1p__11016 | 71 | 2.81 | 89% | 8 of 9 | 70% | 7 of 10 |
| ha1p__11023 | 72 | 2.33 | 56% | 5 of 9 | 90% | 9 of 10 |
| ha1p__12974 | 73 | 0.79 | 67% | 6 of 9 | 80% | 8 of 10 |
| ha1p__16027 | 74 | 1.15 | 67% | 6 of 9 | 90% | 9 of 10 |

TABLE 18-continued

Sensitivity and Specificity of differentially methylated loci in esophageal tumors relative to adjacent histological normal esophageal tissue.

| Feature Name | Locus Number | Threshold | Sensitivity | Pos. of Total | Specificity | Neg. of Total |
|---|---|---|---|---|---|---|
| ha1p__16066 | 75 | 1.17 | 89% | 8 of 9 | 100% | 10 of 10 |
| ha1p__18911 | 76 | 2.13 | 88% | 7 of 8 | 80% | 8 of 10 |
| ha1p__19254 | 77 | 3.38 | 89% | 8 of 9 | 80% | 8 of 10 |
| ha1p__19853 | 78 | 0.76 | 100% | 9 of 9 | 70% | 7 of 10 |
| ha1p__22257 | 79 | 1.64 | 89% | 8 of 9 | 90% | 9 of 10 |
| ha1p__22519 | 80 | 1.76 | 89% | 8 of 9 | 90% | 9 of 10 |
| ha1p__31800 | 81 | 3.47 | 80% | 4 of 5 | 80% | 8 of 10 |
| ha1p__33290 | 82 | 1.26 | 100% | 9 of 9 | 60% | 6 of 10 |
| ha1p__37635 | 83 | 6 | 100% | 9 of 9 | 0% | 0 of 10 |
| ha1p__39189 | 84 | 1.75 | 100% | 9 of 9 | 100% | 10 of 10 |
| ha1p__39511 | 85 | 3.21 | 11% | 1 of 9 | 100% | 10 of 10 |
| ha1p__39752 | 86 | 2.3 | 100% | 9 of 9 | 70% | 7 of 10 |
| ha1p__60945 | 87 | 1.81 | 89% | 8 of 9 | 90% | 9 of 10 |
| ha1p__62183 | 88 | 2.84 | 33% | 3 of 9 | 100% | 10 of 10 |
| ha1p__69418 | 89 | 2.29 | 78% | 7 of 9 | 80% | 8 of 10 |
| ha1p__71224 | 90 | 1.69 | 78% | 7 of 9 | 60% | 6 of 10 |
| ha1p__74221 | 91 | 1.42 | 88% | 7 of 8 | 70% | 7 of 10 |
| ha1p__76289 | 92 | 1.45 | 67% | 6 of 9 | 100% | 8 of 8 |
| ha1p__81050 | 93 | 6 | 89% | 8 of 9 | 80% | 8 of 10 |
| ha1p__81674 | 94 | 1.98 | 67% | 6 of 9 | 90% | 9 of 10 |
| ha1p__86355 | 95 | 2.09 | 33% | 3 of 9 | 89% | 8 of 9 |
| ha1p__98491 | 96 | 2.89 | 44% | 4 of 9 | 80% | 8 of 10 |
| ha1p__99426 | 97 | 1.24 | 89% | 8 of 9 | 90% | 9 of 10 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) adjacent normal samples.
Neg. of Total: Number of negative adjacent normal samples relative to the total number of adjacent normal samples analyzed.

TABLE 19

Sensitivity and Specificity of differentially methylated loci in head and neck tumors relative to adjacent histological normal head and neck tissue.

| Feature Name | Locus Number | Threshold | Sensitivity | Pos. of Total | Specificity | Neg. of Total |
|---|---|---|---|---|---|---|
| CHR01P001976799 | 1 | 6 | 87.50% | 7 of 8 | 40.00% | 2 of 5 |
| CHR01P026794862 | 2 | 0.615 | 57.14% | 4 of 7 | 100.00% | 1 of 1 |
| CHR01P043164342 | 3 | 4.85 | 77.78% | 7 of 9 | 100.00% | 5 of 5 |
| CHR01P063154999 | 4 | 0.875 | 100.00% | 9 of 9 | 80.00% | 4 of 5 |
| CHR01P204123050 | 5 | 1.605 | 44.44% | 4 of 9 | 80.00% | 4 of 5 |
| CHR01P206905110 | 6 | 1.92 | 55.56% | 5 of 9 | 80.00% | 4 of 5 |
| CHR01P225608458 | 7 | 1.8 | 77.78% | 7 of 9 | 100.00% | 5 of 5 |
| CHR02P005061785 | 8 | 3.455 | 66.67% | 6 of 9 | 80.00% | 4 of 5 |
| CHR02P042255672 | 9 | 4.075 | 77.78% | 7 of 9 | 80.00% | 4 of 5 |
| CHR02P223364582 | 10 | 1.7 | 88.89% | 8 of 9 | 100.00% | 5 of 5 |
| CHR03P027740753 | 11 | 1.05 | 88.89% | 8 of 9 | 100.00% | 5 of 5 |
| CHR03P052525960 | 12 | 2.66 | 55.56% | 5 of 9 | 100.00% | 5 of 5 |
| CHR03P069745999 | 13 | 4.04 | 77.78% | 7 of 9 | 100.00% | 5 of 5 |
| CHR05P059799713 | 14 | 1.595 | 66.67% | 6 of 9 | 80.00% | 4 of 5 |
| CHR05P059799813 | 15 | 1.745 | 57.14% | 4 of 7 | 100.00% | 5 of 5 |
| CHR05P177842690 | 16 | 1.12 | 100.00% | 9 of 9 | 60.00% | 3 of 5 |
| CHR06P010694062 | 17 | 2.695 | 66.67% | 6 of 9 | 100.00% | 5 of 5 |
| CHR06P026333318 | 18 | 2.335 | 77.78% | 7 of 9 | 80.00% | 4 of 5 |
| CHR08P102460854 | 19 | 0.625 | 55.56% | 5 of 9 | 80.00% | 4 of 5 |
| CHR08P102461254 | 20 | 0.64 | 88.89% | 8 of 9 | 40.00% | 2 of 5 |
| CHR08P102461554 | 21 | 0.77 | 33.33% | 3 of 9 | 80.00% | 4 of 5 |
| CHR09P000107988 | 22 | 0.97 | 100.00% | 9 of 9 | 100.00% | 5 of 5 |
| CHR09P021958839 | 23 | 1.09 | 88.89% | 8 of 9 | 100.00% | 5 of 5 |
| CHR09P131048752 | 24 | 4.29 | 77.78% | 7 of 9 | 100.00% | 5 of 5 |
| CHR10P118975684 | 25 | 1.405 | 87.50% | 7 of 8 | 80.00% | 4 of 5 |
| CHR11P021861414 | 26 | 4.21 | 88.89% | 8 of 9 | 80.00% | 4 of 5 |
| CHR12P004359362 | 27 | 1.065 | 77.78% | 7 of 9 | 60.00% | 3 of 5 |
| CHR12P016001231 | 28 | 1.25 | 66.67% | 6 of 9 | 60.00% | 3 of 5 |
| CHR14P018893344 | 29 | 2.43 | 88.89% | 8 of 9 | 100.00% | 5 of 5 |
| CHR14P093230340 | 30 | 1.26 | 100.00% | 9 of 9 | 80.00% | 4 of 5 |
| CHR16P000373719 | 31 | 1.215 | 100.00% | 6 of 6 | 75.00% | 3 of 4 |
| CHR16P066389027 | 32 | 1.645 | 77.78% | 7 of 9 | 60.00% | 3 of 5 |

TABLE 19-continued

Sensitivity and Specificity of differentially methylated loci in head and neck tumors relative to adjacent histological normal head and neck tissue.

| Feature Name | Locus Number | Threshold | Sensitivity | Pos. of Total | Specificity | Neg. of Total |
|---|---|---|---|---|---|---|
| CHR16P083319654 | 33 | 3.81 | 100.00% | 9 of 9 | 20.00% | 1 of 5 |
| CHR18P019705147 | 34 | 1.73 | 55.56% | 5 of 9 | 80.00% | 4 of 5 |
| CHR19P018622408 | 35 | 2.245 | 88.89% | 8 of 9 | 80.00% | 4 of 5 |
| CHR19P051892823 | 36 | 3.875 | 80.00% | 4 of 5 | 100.00% | 3 of 3 |
| CHRXP013196410 | 37 | 1.72 | 100.00% | 9 of 9 | 40.00% | 2 of 5 |
| CHRXP013196870 | 38 | 1.38 | 88.89% | 8 of 9 | 40.00% | 2 of 5 |
| ha1p16__00179_l50 | 39 | 1.105 | 88.89% | 8 of 9 | 100.00% | 5 of 5 |
| ha1p16__00182_l50 | 40 | 0.735 | 100.00% | 9 of 9 | 100.00% | 5 of 5 |
| ha1p16__00257_l50 | 41 | 1.495 | 77.78% | 7 of 9 | 100.00% | 5 of 5 |
| ha1p__12601_l50 | 42 | 1.035 | 66.67% | 6 of 9 | 60.00% | 3 of 5 |
| ha1p__17147_l50 | 43 | 1.53 | 37.50% | 3 of 8 | 100.00% | 5 of 5 |
| ha1p__42350_l50 | 44 | 4.505 | 100.00% | 7 of 7 | 80.00% | 4 of 5 |
| ha1p__44897_l50 | 45 | 2.59 | 100.00% | 8 of 8 | 80.00% | 4 of 5 |
| ha1p__61253_l50 | 46 | 1.19 | 88.89% | 8 of 9 | 75.00% | 3 of 4 |
| CHR01P001005050 | 47 | 1.205 | 71.43% | 5 of 7 | 100.00% | 3 of 3 |
| CHR16P001157479 | 48 | — | — | — | — | — |
| ha1g__00681 | 49 | 0.73 | 100% | 9 of 9 | 40% | 2 of 5 |
| ha1g__01966 | 50 | 1.59 | 100% | 9 of 9 | 50% | 2 of 4 |
| ha1g__02153 | 51 | 1.42 | 78% | 7 of 9 | 100% | 5 of 5 |
| ha1g__02319 | 52 | 0.86 | 89% | 8 of 9 | 60% | 3 of 5 |
| ha1g__02335 | 53 | 3.52 | 67% | 6 of 9 | 100% | 5 of 5 |
| ha1p16__00182 | 54 | 0.88 | 89% | 8 of 9 | 100% | 5 of 5 |
| ha1p16__00185 | 55 | 0.99 | 89% | 8 of 9 | 80% | 4 of 5 |
| ha1p16__00193 | 56 | 1.75 | 89% | 8 of 9 | 80% | 4 of 5 |
| ha1p16__00259 | 57 | 2.44 | 67% | 6 of 9 | 80% | 4 of 5 |
| ha1p__02799 | 58 | 2.27 | 100% | 9 of 9 | 40% | 2 of 5 |
| ha1p__03567 | 59 | 1.61 | 89% | 8 of 9 | 40% | 2 of 5 |
| ha1p__03671 | 60 | 0.54 | 100% | 9 of 9 | 100% | 4 of 4 |
| ha1p__05803 | 61 | 1.88 | 78% | 7 of 9 | 80% | 4 of 5 |
| ha1p__07131 | 62 | 3.46 | 78% | 7 of 9 | 100% | 5 of 5 |
| ha1p__07989 | 63 | 2.09 | 83% | 5 of 6 | 80% | 4 of 5 |
| ha1p__08588 | 64 | 5.5 | 67% | 6 of 9 | 60% | 3 of 5 |
| ha1p__09700 | 65 | 0.61 | 50% | 4 of 8 | 80% | 4 of 5 |
| ha1p__104458 | 66 | 4.3 | 78% | 7 of 9 | 100% | 5 of 5 |
| ha1p__105287 | 67 | 1.8 | 67% | 6 of 9 | 80% | 4 of 5 |
| ha1p__10702 | 68 | 1.79 | 33% | 3 of 9 | 100% | 5 of 5 |
| ha1p__108469 | 69 | 1.85 | 22% | 2 of 9 | 100% | 5 of 5 |
| ha1p__108849 | 70 | 2.7 | 67% | 6 of 9 | 80% | 4 of 5 |
| ha1p__11016 | 71 | 3.99 | 100% | 9 of 9 | 80% | 4 of 5 |
| ha1p__11023 | 72 | 2.14 | 100% | 9 of 9 | 60% | 3 of 5 |
| ha1p__12974 | 73 | 0.57 | 78% | 7 of 9 | 60% | 3 of 5 |
| ha1p__16027 | 74 | 0.57 | 100% | 9 of 9 | 60% | 3 of 5 |
| ha1p__16066 | 75 | 0.76 | 89% | 8 of 9 | 80% | 4 of 5 |
| ha1p__18911 | 76 | 2.73 | 89% | 8 of 9 | 60% | 3 of 5 |
| ha1p__19254 | 77 | 2.44 | 67% | 6 of 9 | 100% | 5 of 5 |
| ha1p__19853 | 78 | 0.7 | 89% | 8 of 9 | 100% | 5 of 5 |
| ha1p__22257 | 79 | 1.86 | 78% | 7 of 9 | 100% | 5 of 5 |
| ha1p__22519 | 80 | 2.18 | 56% | 5 of 9 | 100% | 5 of 5 |
| ha1p__31800 | 81 | 2.79 | 100% | 7 of 7 | 40% | 2 of 5 |
| ha1p__33290 | 82 | 1.86 | 78% | 7 of 9 | 100% | 5 of 5 |
| ha1p__37635 | 83 | 6 | 100% | 8 of 8 | 0% | 0 of 5 |
| ha1p__39189 | 84 | 0.97 | 86% | 6 of 7 | 80% | 4 of 5 |
| ha1p__39511 | 85 | 1.88 | 89% | 8 of 9 | 40% | 2 of 5 |
| ha1p__39752 | 86 | 3.02 | 56% | 5 of 9 | 100% | 5 of 5 |
| ha1p__60945 | 87 | 2.31 | 78% | 7 of 9 | 80% | 4 of 5 |
| ha1p__62183 | 88 | 4.34 | 67% | 6 of 9 | 60% | 3 of 5 |
| ha1p__69418 | 89 | 2.22 | 43% | 3 of 7 | 100% | 5 of 5 |
| ha1p__71224 | 90 | 1.89 | 78% | 7 of 9 | 80% | 4 of 5 |
| ha1p__74221 | 91 | 2.08 | 67% | 6 of 9 | 80% | 4 of 5 |
| ha1p__76289 | 92 | 1.5 | 78% | 7 of 9 | 100% | 5 of 5 |
| ha1p__81050 | 93 | 5.46 | 78% | 7 of 9 | 80% | 4 of 5 |
| ha1p__81674 | 94 | 1.88 | 67% | 6 of 9 | 80% | 4 of 5 |
| ha1p__86355 | 95 | 1.18 | 100% | 9 of 9 | 50% | 2 of 4 |
| ha1p__98491 | 96 | 2.27 | 22% | 2 of 9 | 100% | 5 of 5 |
| ha1p__99426 | 97 | 1.13 | 78% | 7 of 9 | 100% | 5 of 5 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) adjacent normal samples.
Neg. of Total: Number of negative adjacent normal samples relative to the total number of adjacent normal samples analyzed.

TABLE 20

Sensitivity and Specificity of differentially methylated loci in liver tumors relative to adjacent histological normal liver tissue.

| Feature Name | Locus Number | Threshold | Sensitivity | Pos. of Total | Specificity | Neg. of Total |
|---|---|---|---|---|---|---|
| CHR01P001976799 | 1 | 6 | 100.00% | 8 of 8 | 0.00% | 0 of 9 |
| CHR01P026794862 | 2 | 1.295 | 42.86% | 3 of 7 | 100.00% | 9 of 9 |
| CHR01P043164342 | 3 | 5.27 | 87.50% | 7 of 8 | 88.89% | 8 of 9 |
| CHR01P063154999 | 4 | 1.4 | 77.78% | 7 of 9 | 71.43% | 5 of 7 |
| CHR01P204123050 | 5 | 2.08 | 33.33% | 3 of 9 | 88.89% | 8 of 9 |
| CHR01P206905110 | 6 | 5.88 | 33.33% | 3 of 9 | 100.00% | 9 of 9 |
| CHR01P225608458 | 7 | 2.62 | 55.56% | 5 of 9 | 88.89% | 8 of 9 |
| CHR02P005061785 | 8 | 4.8 | 55.56% | 5 of 9 | 100.00% | 9 of 9 |
| CHR02P042255672 | 9 | 3.835 | 77.78% | 7 of 9 | 75.00% | 6 of 8 |
| CHR02P223364582 | 10 | 1.73 | 55.56% | 5 of 9 | 77.78% | 7 of 9 |
| CHR03P027740753 | 11 | 1.47 | 55.56% | 5 of 9 | 88.89% | 8 of 9 |
| CHR03P052525960 | 12 | 4.685 | 44.44% | 4 of 9 | 100.00% | 9 of 9 |
| CHR03P069745999 | 13 | 4.745 | 55.56% | 5 of 9 | 100.00% | 8 of 8 |
| CHR05P059799713 | 14 | 3.63 | 50.00% | 4 of 8 | 87.50% | 7 of 8 |
| CHR05P059799813 | 15 | 2.405 | 44.44% | 4 of 9 | 100.00% | 8 of 8 |
| CHR05P177842690 | 16 | 2.12 | 66.67% | 6 of 9 | 100.00% | 9 of 9 |
| CHR06P010694062 | 17 | 4.24 | 66.67% | 6 of 9 | 66.67% | 6 of 9 |
| CHR06P026333318 | 18 | 5.665 | 55.56% | 5 of 9 | 88.89% | 8 of 9 |
| CHR08P102460854 | 19 | 1.305 | 87.50% | 7 of 8 | 55.56% | 5 of 9 |
| CHR08P102461254 | 20 | 1.985 | 66.67% | 6 of 9 | 77.78% | 7 of 9 |
| CHR08P102461554 | 21 | 1.545 | 88.89% | 8 of 9 | 55.56% | 5 of 9 |
| CHR09P000107988 | 22 | 1.705 | 33.33% | 3 of 9 | 88.89% | 8 of 9 |
| CHR09P021958839 | 23 | 2.335 | 66.67% | 6 of 9 | 77.78% | 7 of 9 |
| CHR09P131048752 | 24 | 5.305 | 33.33% | 3 of 9 | 100.00% | 9 of 9 |
| CHR10P118975684 | 25 | 1.59 | 50.00% | 3 of 6 | 100.00% | 7 of 7 |
| CHR11P021861414 | 26 | 4.58 | 33.33% | 3 of 9 | 100.00% | 9 of 9 |
| CHR12P004359362 | 27 | 1.855 | 77.78% | 7 of 9 | 88.89% | 8 of 9 |
| CHR12P016001231 | 28 | 1.515 | 66.67% | 6 of 9 | 55.56% | 5 of 9 |
| CHR14P018893344 | 29 | 3.45 | 66.67% | 6 of 9 | 77.78% | 7 of 9 |
| CHR14P093230340 | 30 | 1.58 | 66.67% | 6 of 9 | 77.78% | 7 of 9 |
| CHR16P000373719 | 31 | 4.565 | 60.00% | 3 of 5 | 75.00% | 3 of 4 |
| CHR16P066389027 | 32 | 1.955 | 88.89% | 8 of 9 | 55.56% | 5 of 9 |
| CHR16P083319654 | 33 | 1.24 | 77.78% | 7 of 9 | 88.89% | 8 of 9 |
| CHR18P019705147 | 34 | 3.76 | 100.00% | 9 of 9 | 100.00% | 6 of 6 |
| CHR19P018622408 | 35 | 3.325 | 66.67% | 6 of 9 | 66.67% | 6 of 9 |
| CHR19P051892823 | 36 | 4.08 | 100.00% | 2 of 2 | 100.00% | 1 of 1 |
| CHRXP013196410 | 37 | 1.215 | 50.00% | 4 of 8 | 85.71% | 6 of 7 |
| CHRXP013196870 | 38 | 1.465 | 75.00% | 6 of 8 | 55.56% | 5 of 9 |
| ha1p16__00179__l50 | 39 | 2.28 | 75.00% | 6 of 8 | 62.50% | 5 of 8 |
| ha1p16__00182__l50 | 40 | 1.775 | 77.78% | 7 of 9 | 77.78% | 7 of 9 |
| ha1p16__00257__l50 | 41 | 0.98 | 88.89% | 8 of 9 | 66.67% | 6 of 9 |
| ha1p__12601__l50 | 42 | 0.915 | 44.44% | 4 of 9 | 100.00% | 8 of 8 |
| ha1p__17147__l50 | 43 | 1.175 | 44.44% | 4 of 9 | 88.89% | 8 of 9 |
| ha1p__42350__l50 | 44 | 1.975 | 42.86% | 3 of 7 | 100.00% | 6 of 6 |
| ha1p__44897__l50 | 45 | 3.59 | 66.67% | 6 of 9 | 75.00% | 6 of 8 |
| ha1p__61253__l50 | 46 | 4.055 | 77.78% | 7 of 9 | 88.89% | 8 of 9 |
| CHR01P001005050 | 47 | 3.3 | 100.00% | 9 of 9 | 77.78% | 7 of 9 |
| CHR16P001157479 | 48 | 6 | 25.00% | 2 of 8 | 100.00% | 5 of 5 |
| ha1g__00681 | 49 | 2.66 | 89% | 8 of 9 | 78% | 7 of 9 |
| ha1g__01966 | 50 | 3.07 | 38% | 3 of 8 | 100% | 9 of 9 |
| ha1g__02153 | 51 | 0.72 | 56% | 5 of 9 | 78% | 7 of 9 |
| ha1g__02319 | 52 | 2.1 | 56% | 5 of 9 | 89% | 8 of 9 |
| ha1g__02335 | 53 | 2.62 | 50% | 4 of 8 | 89% | 8 of 9 |
| ha1p16__00182 | 54 | 1.73 | 89% | 8 of 9 | 78% | 7 of 9 |
| ha1p16__00185 | 55 | 1.65 | 67% | 6 of 9 | 100% | 9 of 9 |
| ha1p16__00193 | 56 | 2.73 | 56% | 5 of 9 | 78% | 7 of 9 |
| ha1p16__00259 | 57 | 3.77 | 78% | 7 of 9 | 89% | 8 of 9 |
| ha1p__02799 | 58 | 2.5 | 78% | 7 of 9 | 86% | 6 of 7 |
| ha1p__03567 | 59 | 0.68 | 33% | 3 of 9 | 89% | 8 of 9 |
| ha1p__03671 | 60 | 2.39 | 44% | 4 of 9 | 78% | 7 of 9 |
| ha1p__05803 | 61 | 2.52 | 56% | 5 of 9 | 89% | 8 of 9 |
| ha1p__07131 | 62 | 2.4 | 89% | 8 of 9 | 89% | 8 of 9 |
| ha1p__07989 | 63 | 1.5 | 88% | 7 of 8 | 56% | 5 of 9 |
| ha1p__08588 | 64 | 3.26 | 89% | 8 of 9 | 89% | 8 of 9 |
| ha1p__09700 | 65 | 0.81 | 50% | 4 of 8 | 100% | 9 of 9 |
| ha1p__104458 | 66 | 3.8 | 67% | 6 of 9 | 56% | 5 of 9 |
| ha1p__105287 | 67 | 3.67 | 44% | 4 of 9 | 100% | 8 of 8 |
| ha1p__10702 | 68 | 0.53 | 56% | 5 of 9 | 67% | 6 of 9 |
| ha1p__108469 | 69 | 2.31 | 44% | 4 of 9 | 89% | 8 of 9 |
| ha1p__108849 | 70 | 3.94 | 56% | 5 of 9 | 78% | 7 of 9 |
| ha1p__11016 | 71 | 4.36 | 44% | 4 of 9 | 89% | 8 of 9 |
| ha1p__11023 | 72 | 2.59 | 33% | 3 of 9 | 100% | 9 of 9 |
| ha1p__12974 | 73 | 0.65 | 89% | 8 of 9 | 22% | 2 of 9 |
| ha1p__16027 | 74 | 1.51 | 63% | 5 of 8 | 89% | 8 of 9 |

TABLE 20-continued

Sensitivity and Specificity of differentially methylated loci in liver tumors relative to adjacent histological normal liver tissue.

| Feature Name | Locus Number | Threshold | Sensitivity | Pos. of Total | Specificity | Neg. of Total |
|---|---|---|---|---|---|---|
| ha1p__16066 | 75 | 1.43 | 67% | 6 of 9 | 78% | 7 of 9 |
| ha1p__18911 | 76 | 2.32 | 56% | 5 of 9 | 67% | 6 of 9 |
| ha1p__19254 | 77 | 1.79 | 100% | 7 of 7 | 89% | 8 of 9 |
| ha1p__19853 | 78 | 0.71 | 50% | 4 of 8 | 78% | 7 of 9 |
| ha1p__22257 | 79 | 2.56 | 67% | 6 of 9 | 89% | 8 of 9 |
| ha1p__22519 | 80 | 2.83 | 56% | 5 of 9 | 78% | 7 of 9 |
| ha1p__31800 | 81 | 2.81 | 67% | 6 of 9 | 56% | 5 of 9 |
| ha1p__33290 | 82 | 0.89 | 44% | 4 of 9 | 100% | 9 of 9 |
| ha1p__37635 | 83 | 6 | 44% | 4 of 9 | 89% | 8 of 9 |
| ha1p__39189 | 84 | 1.29 | 67% | 6 of 9 | 89% | 8 of 9 |
| ha1p__39511 | 85 | 2.01 | 100% | 9 of 9 | 56% | 5 of 9 |
| ha1p__39752 | 86 | 1.09 | 44% | 4 of 9 | 100% | 9 of 9 |
| ha1p__60945 | 87 | 1.74 | 44% | 4 of 9 | 78% | 7 of 9 |
| ha1p__62183 | 88 | 2.48 | 67% | 6 of 9 | 100% | 9 of 9 |
| ha1p__69418 | 89 | 6 | 56% | 5 of 9 | 89% | 8 of 9 |
| ha1p__71224 | 90 | 0.96 | 50% | 4 of 8 | 89% | 8 of 9 |
| ha1p__74221 | 91 | 2.22 | 22% | 2 of 9 | 100% | 9 of 9 |
| ha1p__76289 | 92 | 1.55 | 88% | 7 of 8 | 78% | 7 of 9 |
| ha1p__81050 | 93 | 5.95 | 56% | 5 of 9 | 100% | 9 of 9 |
| ha1p__81674 | 94 | 3.45 | 22% | 2 of 9 | 100% | 9 of 9 |
| ha1p__86355 | 95 | 1.61 | 56% | 5 of 9 | 89% | 8 of 9 |
| ha1p__98491 | 96 | 2.63 | 56% | 5 of 9 | 100% | 9 of 9 |
| ha1p__99426 | 97 | 1.06 | 100% | 9 of 9 | 78% | 7 of 9 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) adjacent normal samples.
Neg. of Total: Number of negative adjacent normal samples relative to the total number of adjacent normal samples analyzed.

TABLE 21

Sensitivity and Specificity of differentially methylated loci in lung tumors relative to adjacent histological normal lung tissue.

| Feature Name | Locus Number | Threshold | Sensitivity | Pos. of Total | Specificity | Neg. of Total |
|---|---|---|---|---|---|---|
| CHR01P001976799 | 1 | 6 | 100.00% | 20 of 20 | 0.00% | 0 of 20 |
| CHR01P026794862 | 2 | 0.855 | 47.06% | 8 of 17 | 88.24% | 15 of 17 |
| CHR01P043164342 | 3 | 2.25 | 80.00% | 16 of 20 | 68.42% | 13 of 19 |
| CHR01P063154999 | 4 | 1.005 | 90.00% | 18 of 20 | 90.00% | 18 of 20 |
| CHR01P204123050 | 5 | 0.835 | 100.00% | 20 of 20 | 15.00% | 3 of 20 |
| CHR01P206905110 | 6 | 1.655 | 55.00% | 11 of 20 | 90.00% | 18 of 20 |
| CHR01P225608458 | 7 | 1.485 | 90.00% | 18 of 20 | 90.00% | 18 of 20 |
| CHR02P005061785 | 8 | 3.955 | 78.95% | 15 of 19 | 57.89% | 11 of 19 |
| CHR02P042255672 | 9 | 4.045 | 85.00% | 17 of 20 | 90.00% | 18 of 20 |
| CHR02P223364582 | 10 | 1.82 | 75.00% | 15 of 20 | 90.00% | 18 of 20 |
| CHR03P027740753 | 11 | 1.19 | 90.00% | 18 of 20 | 100.00% | 18 of 18 |
| CHR03P052525960 | 12 | 2.2 | 30.00% | 6 of 20 | 95.00% | 19 of 20 |
| CHR03P069745999 | 13 | 4.23 | 70.00% | 14 of 20 | 50.00% | 10 of 20 |
| CHR05P059799713 | 14 | 2.075 | 50.00% | 10 of 20 | 80.00% | 16 of 20 |
| CHR05P059799813 | 15 | 2.715 | 30.00% | 6 of 20 | 100.00% | 18 of 18 |
| CHR05P177842690 | 16 | 2.145 | 55.00% | 11 of 20 | 70.00% | 14 of 20 |
| CHR06P010694062 | 17 | 3.31 | 80.00% | 16 of 20 | 85.00% | 17 of 20 |
| CHR06P026333318 | 18 | 3.605 | 80.00% | 16 of 20 | 95.00% | 19 of 20 |
| CHR08P102460854 | 19 | 0.955 | 5.00% | 1 of 20 | 100.00% | 20 of 20 |
| CHR08P102461254 | 20 | 0.57 | 50.00% | 10 of 20 | 75.00% | 15 of 20 |
| CHR08P102461554 | 21 | 0.53 | 40.00% | 8 of 20 | 80.00% | 16 of 20 |
| CHR09P000107988 | 22 | 1.44 | 60.00% | 12 of 20 | 85.00% | 17 of 20 |
| CHR09P021958839 | 23 | 1.525 | 75.00% | 15 of 20 | 90.00% | 18 of 20 |
| CHR09P131048752 | 24 | 3.285 | 90.00% | 18 of 20 | 70.00% | 14 of 20 |
| CHR10P118975684 | 25 | 1.14 | 85.00% | 17 of 20 | 100.00% | 20 of 20 |
| CHR11P021861414 | 26 | 4.05 | 70.00% | 14 of 20 | 90.00% | 18 of 20 |
| CHR12P004359362 | 27 | 2.155 | 70.00% | 14 of 20 | 95.00% | 19 of 20 |
| CHR12P016001231 | 28 | 1.705 | 65.00% | 13 of 20 | 68.42% | 13 of 19 |
| CHR14P018893344 | 29 | 2.5 | 85.00% | 17 of 20 | 78.95% | 15 of 19 |
| CHR14P093230340 | 30 | 1.465 | 89.47% | 17 of 19 | 95.00% | 19 of 20 |
| CHR16P000373719 | 31 | 1.36 | 62.50% | 10 of 16 | 88.24% | 15 of 17 |
| CHR16P066389027 | 32 | 1.195 | 57.89% | 11 of 19 | 66.67% | 12 of 18 |

TABLE 21-continued

Sensitivity and Specificity of differentially methylated loci in lung tumors relative to adjacent histological normal lung tissue.

| Feature Name | Locus Number | Threshold | Sensitivity | Pos. of Total | Specificity | Neg. of Total |
|---|---|---|---|---|---|---|
| CHR16P083319654 | 33 | 1.895 | 80.00% | 16 of 20 | 80.00% | 16 of 20 |
| CHR18P019705147 | 34 | 3.865 | 40.00% | 8 of 20 | 100.00% | 20 of 20 |
| CHR19P018622408 | 35 | 2.105 | 84.21% | 16 of 19 | 90.00% | 18 of 20 |
| CHR19P051892823 | 36 | 1.095 | 83.33% | 10 of 12 | 76.92% | 10 of 13 |
| CHRXP013196410 | 37 | 3.725 | 45.00% | 9 of 20 | 95.00% | 19 of 20 |
| CHRXP013196870 | 38 | 3.12 | 60.00% | 12 of 20 | 80.00% | 16 of 20 |
| ha1p16__00179__l50 | 39 | 1.575 | 65.00% | 13 of 20 | 100.00% | 20 of 20 |
| ha1p16__00182__l50 | 40 | 1.07 | 85.00% | 17 of 20 | 80.00% | 16 of 20 |
| ha1p16__00257__l50 | 41 | 1.045 | 78.95% | 15 of 19 | 90.00% | 18 of 20 |
| ha1p__12601__l50 | 42 | 0.75 | 50.00% | 10 of 20 | 85.00% | 17 of 20 |
| ha1p__17147__l50 | 43 | 0.7 | 60.00% | 12 of 20 | 85.00% | 17 of 20 |
| ha1p__42350__l50 | 44 | 2.205 | 94.12% | 16 of 17 | 73.68% | 14 of 19 |
| ha1p__44897__l50 | 45 | 2.22 | 70.00% | 14 of 20 | 65.00% | 13 of 20 |
| ha1p__61253__l50 | 46 | 1.895 | 77.78% | 14 of 18 | 83.33% | 15 of 18 |
| CHR01P001005050 | 47 | 0.52 | 63.16% | 12 of 19 | 64.71% | 11 of 17 |
| CHR16P001157479 | 48 | — | — | — | — | — |
| ha1g__00681 | 49 | 1.5 | 80% | 8 of 10 | 90% | 9 of 10 |
| ha1g__01966 | 50 | 1.37 | 87% | 40 of 46 | 96% | 46 of 48 |
| ha1g__02153 | 51 | 0.62 | 84% | 38 of 45 | 90% | 43 of 48 |
| ha1g__02319 | 52 | 0.73 | 74% | 35 of 47 | 96% | 45 of 47 |
| ha1g__02335 | 53 | 1.68 | 80% | 8 of 10 | 90% | 9 of 10 |
| ha1p16__00182 | 54 | 1.18 | 65% | 30 of 46 | 90% | 43 of 48 |
| ha1p16__00185 | 55 | 1.1 | 68% | 30 of 44 | 91% | 40 of 44 |
| ha1p16__00193 | 56 | 1.76 | 89% | 40 of 45 | 68% | 32 of 47 |
| ha1p16__00259 | 57 | 2.31 | 75% | 33 of 44 | 93% | 43 of 46 |
| ha1p__02799 | 58 | 2.06 | 47% | 22 of 47 | 88% | 42 of 48 |
| ha1p__03567 | 59 | 1.14 | 78% | 36 of 46 | 83% | 39 of 47 |
| ha1p__03671 | 60 | 1.42 | 76% | 35 of 46 | 65% | 31 of 48 |
| ha1p__05803 | 61 | 1.63 | 70% | 7 of 10 | 90% | 9 of 10 |
| ha1p__07131 | 62 | 3.88 | 83% | 39 of 47 | 93% | 43 of 46 |
| ha1p__07989 | 63 | 2.86 | 85% | 40 of 47 | 90% | 43 of 48 |
| ha1p__08588 | 64 | 3.9 | 80% | 37 of 46 | 88% | 42 of 48 |
| ha1p__09700 | 65 | 1.01 | 56% | 25 of 45 | 93% | 43 of 46 |
| ha1p__104458 | 66 | 3.94 | 80% | 8 of 10 | 89% | 8 of 9 |
| ha1p__105287 | 67 | 2.04 | 83% | 40 of 48 | 73% | 35 of 48 |
| ha1p__10702 | 68 | 0.5 | 66% | 27 of 41 | 87% | 39 of 45 |
| ha1p__108469 | 69 | 0.98 | 83% | 38 of 46 | 89% | 42 of 47 |
| ha1p__108849 | 70 | 3.7 | 70% | 7 of 10 | 100% | 10 of 10 |
| ha1p__11016 | 71 | 2.88 | 70% | 7 of 10 | 100% | 10 of 10 |
| ha1p__11023 | 72 | 3.41 | 100% | 10 of 10 | 20% | 2 of 10 |
| ha1p__12974 | 73 | 0.59 | 36% | 17 of 47 | 90% | 43 of 48 |
| ha1p__16027 | 74 | 1.02 | 73% | 35 of 48 | 92% | 44 of 48 |
| ha1p__16066 | 75 | 0.79 | 73% | 35 of 48 | 85% | 41 of 48 |
| ha1p__18911 | 76 | 2.87 | 70% | 33 of 47 | 96% | 45 of 47 |
| ha1p__19254 | 77 | 3.66 | 90% | 9 of 10 | 90% | 9 of 10 |
| ha1p__19853 | 78 | 0.75 | 79% | 37 of 47 | 92% | 44 of 48 |
| ha1p__22257 | 79 | 1.12 | 80% | 37 of 46 | 85% | 41 of 48 |
| ha1p__22519 | 80 | 1.84 | 78% | 35 of 45 | 94% | 45 of 48 |
| ha1p__31800 | 81 | 2.33 | 88% | 42 of 48 | 92% | 44 of 48 |
| ha1p__33290 | 82 | 1.71 | 87% | 41 of 47 | 92% | 44 of 48 |
| ha1p__37635 | 83 | 2.99 | 70% | 7 of 10 | 80% | 8 of 10 |
| ha1p__39189 | 84 | 0.89 | 83% | 39 of 47 | 90% | 38 of 42 |
| ha1p__39511 | 85 | 2.36 | 78% | 7 of 9 | 78% | 7 of 9 |
| ha1p__39752 | 86 | 1.79 | 65% | 30 of 46 | 81% | 38 of 47 |
| ha1p__60945 | 87 | 2.11 | 60% | 6 of 10 | 100% | 8 of 8 |
| ha1p__62183 | 88 | 4.23 | 82% | 37 of 45 | 83% | 39 of 47 |
| ha1p__69418 | 89 | 2.36 | 85% | 39 of 46 | 93% | 43 of 46 |
| ha1p__71224 | 90 | 1.98 | 77% | 34 of 44 | 77% | 30 of 39 |
| ha1p__74221 | 91 | 1.51 | 70% | 7 of 10 | 100% | 10 of 10 |
| ha1p__76289 | 92 | 1.13 | 81% | 34 of 42 | 83% | 33 of 40 |
| ha1p__81050 | 93 | 5.6 | 92% | 33 of 36 | 87% | 40 of 46 |
| ha1p__81674 | 94 | 1.81 | 74% | 29 of 39 | 87% | 27 of 31 |
| ha1p__86355 | 95 | 1.95 | 39% | 17 of 44 | 88% | 36 of 41 |
| ha1p__98491 | 96 | 2.13 | 38% | 18 of 47 | 94% | 44 of 47 |
| ha1p__99426 | 97 | 1.02 | 83% | 39 of 47 | 92% | 44 of 48 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) adjacent normal samples.
Neg. of Total: Number of negative adjacent normal samples relative to the total number of adjacent normal samples analyzed.

TABLE 22

Sensitivity and Specificity of differentially methylated loci in lung tumors relative to histologically normal lung tissue.

| Feature | Locus No. | Threshold | Sensitivity | Pos. of Total | Specificity | Neg. of Total |
|---|---|---|---|---|---|---|
| ha1g__00681 | 49 | — | — | — | — | — |
| ha1g__01966 | 50 | 1.3 | 89% | 24 of 27 | 95% | 20 of 21 |
| ha1g__02153 | 51 | 0.66 | 81% | 22 of 27 | 91% | 20 of 22 |
| ha1g__02319 | 52 | 0.57 | 83% | 24 of 29 | 95% | 21 of 22 |
| ha1g__02335 | 53 | — | — | — | — | — |
| ha1p16__00182 | 54 | 1.05 | 85% | 23 of 27 | 86% | 19 of 22 |
| ha1p16__00185 | 55 | 1.13 | 76% | 19 of 25 | 100% | 22 of 22 |
| ha1p16__00193 | 56 | 1.83 | 81% | 22 of 27 | 90% | 19 of 21 |
| ha1p16__00259 | 57 | 2.31 | 77% | 20 of 26 | 100% | 21 of 21 |
| ha1p__02799 | 58 | 1.91 | 50% | 14 of 28 | 100% | 21 of 21 |
| ha1p__03567 | 59 | 1.34 | 81% | 22 of 27 | 91% | 20 of 22 |
| ha1p__03671 | 60 | 1.86 | 46% | 13 of 28 | 90% | 19 of 21 |
| ha1p__05803 | 61 | — | — | — | — | — |
| ha1p__07131 | 62 | 3.89 | 82% | 23 of 28 | 100% | 22 of 22 |
| ha1p__07989 | 63 | 3.1 | 86% | 24 of 28 | 95% | 21 of 22 |
| ha1p__08588 | 64 | 4.35 | 86% | 24 of 28 | 95% | 20 of 21 |
| ha1p__09700 | 65 | 1.01 | 64% | 18 of 28 | 91% | 20 of 22 |
| ha1p__104458 | 66 | — | — | — | — | — |
| ha1p__105287 | 67 | 1.96 | 79% | 23 of 29 | 95% | 20 of 21 |
| ha1p__10702 | 68 | 1.16 | 41% | 9 of 22 | 100% | 19 of 19 |
| ha1p__108469 | 69 | 0.99 | 78% | 21 of 27 | 95% | 20 of 21 |
| ha1p__108849 | 70 | — | — | — | — | — |
| ha1p__11016 | 71 | — | — | — | — | — |
| ha1p__11023 | 72 | — | — | — | — | — |
| ha1p__12974 | 73 | 0.61 | 21% | 6 of 28 | 95% | 21 of 22 |
| ha1p__16027 | 74 | 0.66 | 86% | 25 of 29 | 86% | 19 of 22 |
| ha1p__16066 | 75 | 0.79 | 72% | 21 of 29 | 100% | 20 of 20 |
| ha1p__18911 | 76 | 2.69 | 66% | 19 of 29 | 100% | 22 of 22 |
| ha1p__19254 | 77 | — | — | — | — | — |
| ha1p__19853 | 78 | 0.75 | 86% | 24 of 28 | 91% | 20 of 22 |
| ha1p__22257 | 79 | 1.56 | 54% | 15 of 28 | 91% | 20 of 22 |
| ha1p__22519 | 80 | 1.68 | 89% | 24 of 27 | 95% | 21 of 22 |
| ha1p__31800 | 81 | 2.59 | 76% | 22 of 29 | 86% | 19 of 22 |
| ha1p__33290 | 82 | 1.94 | 86% | 25 of 29 | 95% | 21 of 22 |
| ha1p__37635 | 83 | — | — | — | — | — |
| ha1p__39189 | 84 | 0.89 | 86% | 24 of 28 | 86% | 19 of 22 |
| ha1p__39511 | 85 | — | — | — | — | — |
| ha1p__39752 | 86 | 1.96 | 56% | 15 of 27 | 82% | 18 of 22 |
| ha1p__60945 | 87 | — | — | — | — | — |
| ha1p__62183 | 88 | 3.55 | 81% | 21 of 26 | 100% | 22 of 22 |
| ha1p__69418 | 89 | 2.67 | 85% | 23 of 27 | 100% | 21 of 21 |
| ha1p__71224 | 90 | 2.01 | 84% | 21 of 25 | 79% | 15 of 19 |
| ha1p__74221 | 91 | — | — | — | — | — |
| ha1p__76289 | 92 | 1.13 | 80% | 20 of 25 | 83% | 15 of 18 |
| ha1p__81050 | 93 | 6 | 88% | 15 of 17 | 95% | 21 of 22 |
| ha1p__81674 | 94 | 2.4 | 65% | 13 of 20 | 100% | 18 of 18 |
| ha1p__86355 | 95 | 1.7 | 44% | 11 of 25 | 100% | 22 of 22 |
| ha1p__98491 | 96 | 2.14 | 43% | 12 of 28 | 95% | 21 of 22 |
| ha1p__99426 | 97 | 1.02 | 86% | 24 of 28 | 100% | 22 of 22 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) benign normal samples.
Neg. of Total: Number of negative benign normal samples relative to the total number of adjacent normal samples analyzed.

TABLE 23

Frequency of methylation of each locus in melanoma tumors.

| Feature Name | Locus Number | Threshold | Sensitivity | Pos. of Total |
|---|---|---|---|---|
| CHR01P001976799 | 1 | 1.0 | 100.00% | 7 of 7 |
| CHR01P026794862 | 2 | 1.0 | 33.33% | 2 of 6 |
| CHR01P043164342 | 3 | 1.0 | 100.00% | 7 of 7 |
| CHR01P063154999 | 4 | 1.0 | 100.00% | 7 of 7 |
| CHR01P204123050 | 5 | 1.0 | 85.71% | 6 of 7 |
| CHR01P206905110 | 6 | 1.0 | 100.00% | 7 of 7 |
| CHR01P225608458 | 7 | 1.0 | 85.71% | 6 of 7 |
| CHR02P005061785 | 8 | 1.0 | 100.00% | 7 of 7 |
| CHR02P042255672 | 9 | 1.0 | 100.00% | 7 of 7 |
| CHR02P223364582 | 10 | 1.0 | 42.86% | 3 of 7 |
| CHR03P027740753 | 11 | 1.0 | 100.00% | 7 of 7 |
| CHR03P052525960 | 12 | 1.0 | 100.00% | 7 of 7 |
| CHR03P069745999 | 13 | 1.0 | 100.00% | 7 of 7 |
| CHR05P059799713 | 14 | 1.0 | 100.00% | 7 of 7 |
| CHR05P059799813 | 15 | 1.0 | 100.00% | 7 of 7 |
| CHR05P177842690 | 16 | 1.0 | 100.00% | 7 of 7 |
| CHR06P010694062 | 17 | 1.0 | 85.71% | 6 of 7 |
| CHR06P026333318 | 18 | 1.0 | 85.71% | 6 of 7 |
| CHR08P102460854 | 19 | 1.0 | 85.71% | 6 of 7 |
| CHR08P102461254 | 20 | 1.0 | 100.00% | 7 of 7 |
| CHR08P102461554 | 21 | 1.0 | 85.71% | 6 of 7 |
| CHR09P000107988 | 22 | 1.0 | 85.71% | 6 of 7 |
| CHR09P021958839 | 23 | 1.0 | 85.71% | 6 of 7 |
| CHR09P131048752 | 24 | 1.0 | 57.14% | 4 of 7 |
| CHR10P118975684 | 25 | 1.0 | 85.71% | 6 of 7 |
| CHR11P021861414 | 26 | 1.0 | 100.00% | 7 of 7 |
| CHR12P004359362 | 27 | 1.0 | 71.43% | 5 of 7 |
| CHR12P016001231 | 28 | 1.0 | 85.71% | 6 of 7 |
| CHR14P018893344 | 29 | 1.0 | 85.71% | 6 of 7 |
| CHR14P093230340 | 30 | 1.0 | 83.33% | 5 of 6 |
| CHR16P000373719 | 31 | 1.0 | 50.00% | 2 of 4 |
| CHR16P066389027 | 32 | 1.0 | 71.43% | 5 of 7 |
| CHR16P083319654 | 33 | 1.0 | 71.43% | 5 of 7 |
| CHR18P019705147 | 34 | 1.0 | 100.00% | 7 of 7 |
| CHR19P018622408 | 35 | 1.0 | 66.67% | 4 of 6 |
| CHR19P051892823 | 36 | 1.0 | 25.00% | 1 of 4 |
| CHRXP013196410 | 37 | 1.0 | 100.00% | 5 of 5 |
| CHRXP013196870 | 38 | 1.0 | 85.71% | 6 of 7 |
| ha1p16__00179__I50 | 39 | 1.0 | 85.71% | 6 of 7 |
| ha1p16__00182__I50 | 40 | 1.0 | 42.86% | 3 of 7 |
| ha1p16__00257__I50 | 41 | 1.0 | 57.14% | 4 of 7 |
| ha1p__12601__I50 | 42 | 1.0 | 71.43% | 5 of 7 |
| ha1p__17147__I50 | 43 | 1.0 | 100.00% | 7 of 7 |
| ha1p__42350__I50 | 44 | 1.0 | 100.00% | 4 of 4 |
| ha1p__44897__I50 | 45 | 1.0 | 100.00% | 7 of 7 |
| ha1p__61253__I50 | 46 | 1.0 | 57.14% | 4 of 7 |
| CHR01P001005050 | 47 | 1.0 | 100.00% | 4 of 4 |
| CHR16P001157479 | 48 | 1.0 | 100.00% | 1 of 1 |
| ha1g__00681 | 49 | 1.0 | 71% | 5 of 7 |
| ha1g__01966 | 50 | 1.0 | 86% | 6 of 7 |
| ha1g__02153 | 51 | 1.0 | 86% | 6 of 7 |
| ha1g__02319 | 52 | 1.0 | 57% | 4 of 7 |
| ha1g__02335 | 53 | 1.0 | 86% | 6 of 7 |
| ha1p16__00182 | 54 | 1.0 | 43% | 3 of 7 |
| ha1p16__00185 | 55 | 1.0 | 71% | 5 of 7 |
| ha1p16__00193 | 56 | 1.0 | 100% | 6 of 6 |
| ha1p16__00259 | 57 | 1.0 | 100% | 7 of 7 |
| ha1p__02799 | 58 | 1.0 | 100% | 7 of 7 |
| ha1p__03567 | 59 | 1.0 | 57% | 4 of 7 |
| ha1p__03671 | 60 | 1.0 | 0% | 0 of 6 |
| ha1p__05803 | 61 | 1.0 | 57% | 4 of 7 |
| ha1p__07131 | 62 | 1.0 | 86% | 6 of 7 |
| ha1p__07989 | 63 | 1.0 | 80% | 4 of 5 |
| ha1p__08588 | 64 | 1.0 | 86% | 6 of 7 |
| ha1p__09700 | 65 | 1.0 | 50% | 2 of 4 |
| ha1p__104458 | 66 | 1.0 | 86% | 6 of 7 |
| ha1p__105287 | 67 | 1.0 | 100% | 7 of 7 |
| ha1p__10702 | 68 | 1.0 | 71% | 5 of 7 |
| ha1p__108469 | 69 | 1.0 | 86% | 6 of 7 |
| ha1p__108849 | 70 | 1.0 | 100% | 7 of 7 |
| ha1p__11016 | 71 | 1.0 | 100% | 7 of 7 |
| ha1p__11023 | 72 | 1.0 | 86% | 6 of 7 |
| ha1p__12974 | 73 | 1.0 | 14% | 1 of 7 |
| ha1p__16027 | 74 | 1.0 | 100% | 7 of 7 |
| ha1p__16066 | 75 | 1.0 | 86% | 6 of 7 |
| ha1p__18911 | 76 | 1.0 | 86% | 6 of 7 |
| ha1p__19254 | 77 | 1.0 | 100% | 7 of 7 |
| ha1p__19853 | 78 | 1.0 | 29% | 2 of 7 |
| ha1p__22257 | 79 | 1.0 | 100% | 7 of 7 |
| ha1p__22519 | 80 | 1.0 | 86% | 6 of 7 |
| ha1p__31800 | 81 | 1.0 | 100% | 7 of 7 |
| ha1p__33290 | 82 | 1.0 | 86% | 6 of 7 |

TABLE 23-continued

Frequency of methylation of each locus in melanoma tumors.

| Feature Name | Locus Number | Threshold | Sensitivity | Pos. of Total |
|---|---|---|---|---|
| ha1p__37635 | 83 | 1.0 | 100% | 7 of 7 |
| ha1p__39189 | 84 | 1.0 | 86% | 6 of 7 |
| ha1p__39511 | 85 | 1.0 | 43% | 3 of 7 |
| ha1p__39752 | 86 | 1.0 | 100% | 7 of 7 |
| ha1p__60945 | 87 | 1.0 | 86% | 6 of 7 |
| ha1p__62183 | 88 | 1.0 | 100% | 7 of 7 |
| ha1p__69418 | 89 | 1.0 | 71% | 5 of 7 |
| ha1p__71224 | 90 | 1.0 | 57% | 4 of 7 |
| ha1p__74221 | 91 | 1.0 | 86% | 6 of 7 |
| ha1p__76289 | 92 | 1.0 | 57% | 4 of 7 |
| ha1p__81050 | 93 | 1.0 | 86% | 6 of 7 |
| ha1p__81674 | 94 | 1.0 | 100% | 7 of 7 |
| ha1p__86355 | 95 | 1.0 | 100% | 7 of 7 |
| ha1p__98491 | 96 | 1.0 | 86% | 6 of 7 |
| ha1p__99426 | 97 | 1.0 | 71% | 5 of 7 |

Sensitivity: % of positive (i.e., methylation score above 1.0) tumors.
Pos. of Total: Number of positive tumors relative to the total number of tumors analyzed.
Note that adjacent histology normal or normal skin samples were not available for analysis.
Threshold for a positive methylation score was set at an average dCt of 1.0.

TABLE 24

Sensitivity and Specificity of differentially methylated loci in ovarian tumors relative to histologically normal ovarian tissue.

| Feature Name | Locus Number | Threshold | Sensitivity | Pos. of Total | Specificity | Neg. of Total |
|---|---|---|---|---|---|---|
| CHR01P001976799 | 1 | 1.405 | 91.18% | 31 of 34 | 96.97% | 32 of 33 |
| CHR01P026794862 | 2 | 1.32 | 25.00% | 7 of 28 | 87.88% | 29 of 33 |
| CHR01P043164342 | 3 | 5.35 | 91.18% | 31 of 34 | 97.14% | 34 of 35 |
| CHR01P063154999 | 4 | 0.8 | 85.29% | 29 of 34 | 94.12% | 32 of 34 |
| CHR01P204123050 | 5 | 1.165 | 72.73% | 24 of 33 | 73.53% | 25 of 34 |
| CHR01P206905110 | 6 | 5.6 | 88.24% | 30 of 34 | 97.14% | 34 of 35 |
| CHR01P225608458 | 7 | 1.51 | 73.53% | 25 of 34 | 94.29% | 33 of 35 |
| CHR02P005061785 | 8 | 1.565 | 93.94% | 31 of 33 | 97.14% | 34 of 35 |
| CHR02P042255672 | 9 | 0.835 | 85.29% | 29 of 34 | 97.14% | 34 of 35 |
| CHR02P223364582 | 10 | 1.485 | 85.29% | 29 of 34 | 94.29% | 33 of 35 |
| CHR03P027740753 | 11 | 0.69 | 85.29% | 29 of 34 | 96.97% | 32 of 33 |
| CHR03P052525960 | 12 | 1.985 | 55.88% | 19 of 34 | 97.06% | 33 of 34 |
| CHR03P069745999 | 13 | 4.645 | 73.53% | 25 of 34 | 94.29% | 33 of 35 |
| CHR05P059799713 | 14 | 1.735 | 64.71% | 22 of 34 | 90.91% | 30 of 33 |
| CHR05P059799813 | 15 | 1.78 | 64.71% | 22 of 34 | 88.24% | 30 of 34 |
| CHR05P177842690 | 16 | 1.545 | 85.29% | 29 of 34 | 85.71% | 30 of 35 |
| CHR06P010694062 | 17 | 1.235 | 85.29% | 29 of 34 | 85.71% | 30 of 35 |
| CHR06P026333318 | 18 | 1.705 | 94.12% | 32 of 34 | 94.29% | 33 of 35 |
| CHR08P102460854 | 19 | 1.045 | 81.82% | 27 of 33 | 94.29% | 33 of 35 |
| CHR08P102461254 | 20 | 1.835 | 87.88% | 29 of 33 | 94.29% | 33 of 35 |
| CHR08P102461554 | 21 | 1.57 | 84.85% | 28 of 33 | 94.29% | 33 of 35 |
| CHR09P000107988 | 22 | 0.75 | 88.24% | 30 of 34 | 82.86% | 29 of 35 |
| CHR09P021958839 | 23 | 1.575 | 79.41% | 27 of 34 | 96.97% | 32 of 33 |
| CHR09P131048752 | 24 | 1.055 | 91.18% | 31 of 34 | 94.29% | 33 of 35 |
| CHR10P118975684 | 25 | 2.51 | 61.76% | 21 of 34 | 91.43% | 32 of 35 |
| CHR11P021861414 | 26 | 4.195 | 47.06% | 16 of 34 | 97.14% | 34 of 35 |
| CHR12P004359362 | 27 | 2.52 | 67.65% | 23 of 34 | 94.12% | 32 of 34 |
| CHR12P016001231 | 28 | 1.375 | 71.88% | 23 of 32 | 84.85% | 28 of 33 |
| CHR14P018893344 | 29 | 1.185 | 82.35% | 28 of 34 | 100.00% | 34 of 34 |
| CHR14P093230340 | 30 | 1.695 | 91.18% | 31 of 34 | 97.14% | 34 of 35 |
| CHR16P000373719 | 31 | 2.57 | 84.21% | 16 of 19 | 82.14% | 23 of 28 |
| CHR16P066389027 | 32 | 0.595 | 64.71% | 22 of 34 | 88.57% | 31 of 35 |
| CHR16P083319654 | 33 | 1.355 | 67.65% | 23 of 34 | 88.57% | 31 of 35 |
| CHR18P019705147 | 34 | 6 | 88.24% | 30 of 34 | 97.06% | 33 of 34 |
| CHR19P018622408 | 35 | 0.87 | 91.18% | 31 of 34 | 97.06% | 33 of 34 |
| CHR19P051892823 | 36 | 1.03 | 64.29% | 9 of 14 | 86.67% | 13 of 15 |
| CHRXP013196410 | 37 | 0.905 | 96.97% | 32 of 33 | 84.38% | 27 of 32 |
| CHRXP013196870 | 38 | 0.795 | 100.00% | 34 of 34 | 75.76% | 25 of 33 |
| ha1p16__00179__l50 | 39 | 1.085 | 88.24% | 30 of 34 | 94.29% | 33 of 35 |
| ha1p16__00182__l50 | 40 | 1.315 | 79.41% | 27 of 34 | 100.00% | 35 of 35 |
| ha1p16__00257__l50 | 41 | 1.07 | 86.21% | 25 of 29 | 90.00% | 27 of 30 |
| ha1p__12601__l50 | 42 | 2.915 | 94.12% | 32 of 34 | 94.12% | 32 of 34 |
| ha1p__17147__l50 | 43 | 3.72 | 93.94% | 31 of 33 | 94.12% | 32 of 34 |
| ha1p__42350__l50 | 44 | 0.785 | 62.07% | 18 of 29 | 96.67% | 29 of 30 |
| ha1p__44897__l50 | 45 | 2.84 | 88.24% | 30 of 34 | 96.97% | 32 of 33 |
| ha1p__61253__l50 | 46 | 0.905 | 79.31% | 23 of 29 | 96.30% | 26 of 27 |
| CHR01P001005050 | 47 | 5.195 | 100.00% | 28 of 28 | 87.50% | 7 of 8 |
| CHR16P001157479 | 48 | 3 | 84.21% | 16 of 19 | 91.67% | 11 of 12 |
| ha1g__00681 | 49 | 0.75 | 78% | 14 of 18 | 100% | 18 of 18 |
| ha1g__01966 | 50 | 1.54 | 89% | 16 of 18 | 100% | 18 of 18 |
| ha1g__02153 | 51 | 3.62 | 39% | 7 of 18 | 94% | 17 of 18 |
| ha1g__02319 | 52 | 0.57 | 78% | 14 of 18 | 94% | 17 of 18 |
| ha1g__02335 | 53 | 4.77 | 61% | 11 of 18 | 83% | 15 of 18 |
| ha1p16__00182 | 54 | 0.87 | 83% | 15 of 18 | 94% | 17 of 18 |

TABLE 24-continued

Sensitivity and Specificity of differentially methylated loci in ovarian tumors relative to histologically normal ovarian tissue.

| Feature Name | Locus Number | Threshold | Sensitivity | Pos. of Total | Specificity | Neg. of Total |
|---|---|---|---|---|---|---|
| ha1p16__00185 | 55 | 1.39 | 88% | 15 of 17 | 89% | 16 of 18 |
| ha1p16__00193 | 56 | 1.96 | 89% | 16 of 18 | 100% | 18 of 18 |
| ha1p16__00259 | 57 | 1.91 | 83% | 15 of 18 | 56% | 10 of 18 |
| ha1p__02799 | 58 | 5.54 | 61% | 11 of 18 | 78% | 14 of 18 |
| ha1p__03567 | 59 | 1.21 | 56% | 10 of 18 | 67% | 12 of 18 |
| ha1p__03671 | 60 | 0.65 | 78% | 14 of 18 | 56% | 10 of 18 |
| ha1p__05803 | 61 | 1.96 | 78% | 14 of 18 | 100% | 18 of 18 |
| ha1p__07131 | 62 | 5.03 | 76% | 13 of 17 | 89% | 16 of 18 |
| ha1p__07989 | 63 | 2.75 | 39% | 7 of 18 | 100% | 16 of 16 |
| ha1p__08588 | 64 | 6 | 61% | 11 of 18 | 100% | 18 of 18 |
| ha1p__09700 | 65 | 0.55 | 25% | 4 of 16 | 88% | 14 of 16 |
| ha1p__104458 | 66 | 5.08 | 78% | 14 of 18 | 100% | 18 of 18 |
| ha1p__105287 | 67 | 5.01 | 94% | 17 of 18 | 94% | 17 of 18 |
| ha1p__10702 | 68 | 0.54 | 44% | 8 of 18 | 100% | 18 of 18 |
| ha1p__108469 | 69 | 1.42 | 78% | 14 of 18 | 78% | 14 of 18 |
| ha1p__108849 | 70 | 3.1 | 56% | 10 of 18 | 100% | 18 of 18 |
| ha1p__11016 | 71 | 4.39 | 94% | 17 of 18 | 78% | 14 of 18 |
| ha1p__11023 | 72 | 2.83 | 39% | 7 of 18 | 100% | 18 of 18 |
| ha1p__12974 | 73 | 0.55 | 44% | 8 of 18 | 89% | 16 of 18 |
| ha1p__16027 | 74 | 1.02 | 83% | 15 of 18 | 100% | 17 of 17 |
| ha1p__16066 | 75 | 2.47 | 78% | 14 of 18 | 56% | 10 of 18 |
| ha1p__18911 | 76 | 3.16 | 78% | 14 of 18 | 100% | 18 of 18 |
| ha1p__19254 | 77 | 3.77 | 67% | 12 of 18 | 100% | 18 of 18 |
| ha1p__19853 | 78 | 0.61 | 83% | 15 of 18 | 89% | 16 of 18 |
| ha1p__22257 | 79 | 1.7 | 72% | 13 of 18 | 100% | 18 of 18 |
| ha1p__22519 | 80 | 2.05 | 78% | 14 of 18 | 100% | 18 of 18 |
| ha1p__31800 | 81 | 2.82 | 82% | 14 of 17 | 83% | 15 of 18 |
| ha1p__33290 | 82 | 1.52 | 72% | 13 of 18 | 94% | 17 of 18 |
| ha1p__37635 | 83 | 6 | 6% | 1 of 18 | 100% | 17 of 17 |
| ha1p__39189 | 84 | 0.86 | 88% | 14 of 16 | 76% | 13 of 17 |
| ha1p__39511 | 85 | 3.87 | 44% | 8 of 18 | 83% | 15 of 18 |
| ha1p__39752 | 86 | 1.73 | 78% | 14 of 18 | 100% | 18 of 18 |
| ha1p__60945 | 87 | 0.93 | 61% | 11 of 18 | 72% | 13 of 18 |
| ha1p__62183 | 88 | 4.12 | 33% | 6 of 18 | 100% | 18 of 18 |
| ha1p__69418 | 89 | 2.67 | 61% | 11 of 18 | 94% | 17 of 18 |
| ha1p__71224 | 90 | 1.21 | 89% | 16 of 18 | 89% | 16 of 18 |
| ha1p__74221 | 91 | 1.85 | 59% | 10 of 17 | 88% | 15 of 17 |
| ha1p__76289 | 92 | 0.61 | 79% | 11 of 14 | 88% | 14 of 16 |
| ha1p__81050 | 93 | 5.34 | 78% | 14 of 18 | 100% | 18 of 18 |
| ha1p__81674 | 94 | 0.98 | 89% | 16 of 18 | 89% | 16 of 18 |
| ha1p__86355 | 95 | 1.6 | 78% | 14 of 18 | 100% | 18 of 18 |
| ha1p__98491 | 96 | 4.57 | 78% | 14 of 18 | 100% | 18 of 18 |
| ha1p__99426 | 97 | 0.53 | 83% | 15 of 18 | 89% | 16 of 18 |

Threshold: Average dCt value established by ROC curve analysis as optimal threshold for distinguishing tumor and adjacent normal tissues.
Sensitivity: % of positive (i.e. methylation score above Threshold for gain of methylation markers or below Threshold for loss of methylation markers) tumors.
Pos. of Total: Number of positive tumors relative to the total number of tumors analyzed.
Specificity: % of negative (i.e. methylation score below Threshold for gain of methylation markers or above Threshold for loss of methylation markers) adjacent normal samples.
Neg. of Total: Number of negative adjacent normal samples relative to the total number of adjacent normal samples analyzed.

TABLE 25

Sensitivity and Specificity of differentially methylated loci in prostate tumors relative to adjacent histological normal prostate tissue.

| Feature Name | Locus Number | Threshold | Sensitivity | Pos. of Total | Specificity | Neg. of Total |
|---|---|---|---|---|---|---|
| CHR01P001976799 | 1 | 4.025 | 100.00% | 9 of 9 | 33.33% | 3 of 9 |
| CHR01P026794862 | 2 | 0.505 | 0.00% | 0 of 3 | 80.00% | 4 of 5 |
| CHR01P043164342 | 3 | 1.755 | 66.67% | 6 of 9 | 77.78% | 7 of 9 |
| CHR01P063154999 | 4 | 1.535 | 50.00% | 4 of 8 | 100.00% | 9 of 9 |
| CHR01P204123050 | 5 | 1.88 | 71.43% | 5 of 7 | 87.50% | 7 of 8 |
| CHR01P206905110 | 6 | 2.93 | 66.67% | 6 of 9 | 100.00% | 8 of 8 |
| CHR01P225608458 | 7 | 1.785 | 88.89% | 8 of 9 | 77.78% | 7 of 9 |
| CHR02P005061785 | 8 | 3.505 | 88.89% | 8 of 9 | 77.78% | 7 of 9 |
| CHR02P042255672 | 9 | 1.98 | 100.00% | 9 of 9 | 77.78% | 7 of 9 |
| CHR02P223364582 | 10 | 1.94 | 66.67% | 6 of 9 | 100.00% | 9 of 9 |
| CHR03P027740753 | 11 | 1.3 | 77.78% | 7 of 9 | 100.00% | 9 of 9 |
| CHR03P052525960 | 12 | 2.135 | 77.78% | 7 of 9 | 77.78% | 7 of 9 |

TABLE 25-continued

Sensitivity and Specificity of differentially methylated loci in prostate tumors
relative to adjacent histological normal prostate tissue.

| Feature Name | Locus Number | Threshold | Sensitivity | Pos. of Total | Specificity | Neg. of Total |
|---|---|---|---|---|---|---|
| CHR03P069745999 | 13 | 1.585 | 75.00% | 6 of 8 | 66.67% | 6 of 9 |
| CHR05P059799713 | 14 | 0.685 | 55.56% | 5 of 9 | 77.78% | 7 of 9 |
| CHR05P059799813 | 15 | 0.69 | 55.56% | 5 of 9 | 66.67% | 6 of 9 |
| CHR05P177842690 | 16 | 2.055 | 55.56% | 5 of 9 | 77.78% | 7 of 9 |
| CHR06P010694062 | 17 | 2.36 | 88.89% | 8 of 9 | 88.89% | 8 of 9 |
| CHR06P026333318 | 18 | 1.825 | 87.50% | 7 of 8 | 100.00% | 9 of 9 |
| CHR08P102460854 | 19 | 0.82 | 100.00% | 9 of 9 | 66.67% | 6 of 9 |
| CHR08P102461254 | 20 | 0.82 | 88.89% | 8 of 9 | 66.67% | 6 of 9 |
| CHR08P102461554 | 21 | 0.925 | 100.00% | 9 of 9 | 62.50% | 5 of 8 |
| CHR09P000107988 | 22 | 1.355 | 88.89% | 8 of 9 | 77.78% | 7 of 9 |
| CHR09P021958839 | 23 | 1.565 | 77.78% | 7 of 9 | 100.00% | 9 of 9 |
| CHR09P131048752 | 24 | 2.19 | 77.78% | 7 of 9 | 100.00% | 8 of 8 |
| CHR10P118975684 | 25 | 1.665 | 55.56% | 5 of 9 | 87.50% | 7 of 8 |
| CHR11P021861414 | 26 | 4.785 | 87.50% | 7 of 8 | 88.89% | 8 of 9 |
| CHR12P004359362 | 27 | 2.895 | 66.67% | 6 of 9 | 100.00% | 9 of 9 |
| CHR12P016001231 | 28 | 1.365 | 77.78% | 7 of 9 | 66.67% | 6 of 9 |
| CHR14P018893344 | 29 | 1.48 | 66.67% | 6 of 9 | 100.00% | 9 of 9 |
| CHR14P093230340 | 30 | 1.97 | 77.78% | 7 of 9 | 88.89% | 8 of 9 |
| CHR16P000373719 | 31 | 0.81 | 50.00% | 3 of 6 | 100.00% | 3 of 3 |
| CHR16P066389027 | 32 | 1.31 | 55.56% | 5 of 9 | 77.78% | 7 of 9 |
| CHR16P083319654 | 33 | 1.95 | 66.67% | 6 of 9 | 88.89% | 8 of 9 |
| CHR18P019705147 | 34 | 2.89 | 85.71% | 6 of 7 | 88.89% | 8 of 9 |
| CHR19P018622408 | 35 | 1.65 | 88.89% | 8 of 9 | 77.78% | 7 of 9 |
| CHR19P051892823 | 36 | 1.175 | 100.00% | 3 of 3 | 66.67% | 2 of 3 |
| CHRXP013196410 | 37 | 3.205 | 100.00% | 9 of 9 | 77.78% | 7 of 9 |
| CHRXP013196870 | 38 | 4.015 | 77.78% | 7 of 9 | 87.50% | 7 of 8 |
| ha1p16__00179_l50 | 39 | 1.55 | 66.67% | 6 of 9 | 100.00% | 8 of 8 |
| ha1p16__00182_l50 | 40 | 1.32 | 55.56% | 5 of 9 | 100.00% | 9 of 9 |
| ha1p16__00257_l50 | 41 | 1.52 | 77.78% | 7 of 9 | 100.00% | 9 of 9 |
| ha1p__12601_l50 | 42 | 1.01 | 100.00% | 9 of 9 | 77.78% | 7 of 9 |
| ha1p__17147_l50 | 43 | 1.425 | 88.89% | 8 of 9 | 66.67% | 6 of 9 |
| ha1p__42350_l50 | 44 | 3.88 | 66.67% | 6 of 9 | 71.43% | 5 of 7 |
| ha1p__44897_l50 | 45 | 3.845 | 55.56% | 5 of 9 | 100.00% | 9 of 9 |
| ha1p__61253_l50 | 46 | 1.4 | 62.50% | 5 of 8 | 85.71% | 6 of 7 |
| CHR01P001005050 | 47 | 0.69 | 75.00% | 6 of 8 | 55.56% | 5 of 9 |
| CHR16P001157479 | 48 | — | — | — | — | — |
| ha1g__00681 | 49 | 0.76 | 89% | 8 of 9 | 89% | 8 of 9 |
| ha1g__01966 | 50 | 2.54 | 89% | 8 of 9 | 67% | 6 of 9 |
| ha1g__02153 | 51 | 1.04 | 56% | 5 of 9 | 78% | 7 of 9 |
| ha1g__02319 | 52 | 0.86 | 100% | 9 of 9 | 56% | 5 of 9 |
| ha1g__02335 | 53 | 3.58 | 56% | 5 of 9 | 67% | 6 of 9 |
| ha1p16__00182 | 54 | 1.14 | 75% | 6 of 8 | 78% | 7 of 9 |
| ha1p16__00185 | 55 | 1.04 | 78% | 7 of 9 | 78% | 7 of 9 |
| ha1p16__00193 | 56 | 1.6 | 78% | 7 of 9 | 78% | 7 of 9 |
| ha1p16__00259 | 57 | 2.02 | 78% | 7 of 9 | 78% | 7 of 9 |
| ha1p__02799 | 58 | 4.92 | 22% | 2 of 9 | 100% | 9 of 9 |
| ha1p__03567 | 59 | 1.8 | 44% | 4 of 9 | 78% | 7 of 9 |
| ha1p__03671 | 60 | 1.26 | 89% | 8 of 9 | 78% | 7 of 9 |
| ha1p__05803 | 61 | 1.67 | 89% | 8 of 9 | 89% | 8 of 9 |
| ha1p__07131 | 62 | 6 | 67% | 6 of 9 | 78% | 7 of 9 |
| ha1p__07989 | 63 | 2.88 | 75% | 6 of 8 | 89% | 8 of 9 |
| ha1p__08588 | 64 | 5.59 | 44% | 4 of 9 | 78% | 7 of 9 |
| ha1p__09700 | 65 | 0.84 | 86% | 6 of 7 | 100% | 9 of 9 |
| ha1p__104458 | 66 | 3.59 | 100% | 9 of 9 | 67% | 6 of 9 |
| ha1p__105287 | 67 | 1.24 | 67% | 6 of 9 | 67% | 6 of 9 |
| ha1p__10702 | 68 | 2.81 | 78% | 7 of 9 | 78% | 7 of 9 |
| ha1p__108469 | 69 | 1.13 | 100% | 9 of 9 | 78% | 7 of 9 |
| ha1p__108849 | 70 | 2.24 | 56% | 5 of 9 | 67% | 6 of 9 |
| ha1p__11016 | 71 | 3.63 | 100% | 9 of 9 | 78% | 7 of 9 |
| ha1p__11023 | 72 | 1.8 | 78% | 7 of 9 | 67% | 6 of 9 |
| ha1p__12974 | 73 | 1.05 | 67% | 6 of 9 | 100% | 9 of 9 |
| ha1p__16027 | 74 | 1.24 | 89% | 8 of 9 | 50% | 4 of 8 |
| ha1p__16066 | 75 | 2.53 | 100% | 9 of 9 | 44% | 4 of 9 |
| ha1p__18911 | 76 | 2.49 | 100% | 9 of 9 | 75% | 6 of 8 |
| ha1p__19254 | 77 | 4.59 | 50% | 4 of 8 | 78% | 7 of 9 |
| ha1p__19853 | 78 | 0.97 | 88% | 7 of 8 | 88% | 7 of 8 |
| ha1p__22257 | 79 | 2.7 | 78% | 7 of 9 | 67% | 6 of 9 |
| ha1p__22519 | 80 | 1.51 | 100% | 9 of 9 | 78% | 7 of 9 |
| ha1p__31800 | 81 | 2.51 | 100% | 9 of 9 | 56% | 5 of 9 |
| ha1p__33290 | 82 | 1.77 | 78% | 7 of 9 | 78% | 7 of 9 |
| ha1p__37635 | 83 | 6 | 100% | 9 of 9 | 0% | 0 of 9 |
| ha1p__39189 | 84 | 1.52 | 89% | 8 of 9 | 78% | 7 of 9 |
| ha1p__39511 | 85 | 3.59 | 89% | 8 of 9 | 44% | 4 of 9 |
| ha1p__39752 | 86 | 1.82 | 56% | 5 of 9 | 78% | 7 of 9 |

TABLE 25-continued

Sensitivity and Specificity of differentially methylated loci in prostate tumors relative to adjacent histological normal prostate tissue.

| Feature Name | Locus Number | Threshold | Sensitivity | Pos. of Total | Specificity | Neg. of Total |
|---|---|---|---|---|---|---|
| ha1p__60945 | 87 | 1.41 | 78% | 7 of 9 | 56% | 5 of 9 |
| ha1p__62183 | 88 | 4.21 | 67% | 6 of 9 | 78% | 7 of 9 |
| ha1p__69418 | 89 | 3.72 | 63% | 5 of 8 | 78% | 7 of 9 |
| ha1p__71224 | 90 | 1.92 | 56% | 5 of 9 | 78% | 7 of 9 |
| ha1p__74221 | 91 | 1.71 | 78% | 7 of 9 | 44% | 4 of 9 |
| ha1p__76289 | 92 | 0.6 | 100% | 9 of 9 | 56% | 5 of 9 |
| ha1p__81050 | 93 | 6 | 44% | 4 of 9 | 78% | 7 of 9 |
| ha1p__81674 | 94 | 1.2 | 100% | 8 of 8 | 63% | 5 of 8 |
| ha1p__86355 | 95 | 1.54 | 100% | 8 of 8 | 56% | 5 of 9 |
| ha1p__98491 | 96 | 2.91 | 78% | 7 of 9 | 56% | 5 of 9 |
| ha1p__99426 | 97 | 0.77 | 78% | 7 of 9 | 78% | 7 of 9 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) adjacent normal samples.
Neg. of Total: Number of negative adjacent normal samples relative to the total number of adjacent normal samples analyzed.

TABLE 26

Sensitivity and Specificity of differentially methylated loci in renal tumors relative to adjacent histological normal renal tissue.

| Feature Name | Locus Number | Threshold | Sensitivity | Pos. of Total | Specificity | Neg. of Total |
|---|---|---|---|---|---|---|
| CHR01P001976799 | 1 | 4.745 | 66.67% | 6 of 9 | 90.00% | 9 of 10 |
| CHR01P026794862 | 2 | 0.525 | 75.00% | 6 of 8 | 80.00% | 4 of 5 |
| CHR01P043164342 | 3 | 1.555 | 100.00% | 10 of 10 | 80.00% | 8 of 10 |
| CHR01P063154999 | 4 | 1.28 | 90.00% | 9 of 10 | 80.00% | 8 of 10 |
| CHR01P204123050 | 5 | 2.105 | 77.78% | 7 of 9 | 55.56% | 5 of 9 |
| CHR01P206905110 | 6 | 4.285 | 60.00% | 6 of 10 | 100.00% | 10 of 10 |
| CHR01P225608458 | 7 | 1.56 | 80.00% | 8 of 10 | 90.00% | 9 of 10 |
| CHR02P005061785 | 8 | 4.32 | 80.00% | 8 of 10 | 40.00% | 4 of 10 |
| CHR02P042255672 | 9 | 2.145 | 60.00% | 6 of 10 | 90.00% | 9 of 10 |
| CHR02P223364582 | 10 | 1.89 | 66.67% | 6 of 9 | 90.00% | 9 of 10 |
| CHR03P027740753 | 11 | 1.23 | 90.00% | 9 of 10 | 90.00% | 9 of 10 |
| CHR03P052525960 | 12 | 2.69 | 80.00% | 8 of 10 | 90.00% | 9 of 10 |
| CHR03P069745999 | 13 | 1.615 | 100.00% | 10 of 10 | 90.00% | 9 of 10 |
| CHR05P059799713 | 14 | 3.425 | 80.00% | 8 of 10 | 100.00% | 10 of 10 |
| CHR05P059799813 | 15 | 3.395 | 80.00% | 8 of 10 | 100.00% | 10 of 10 |
| CHR05P177842690 | 16 | 1.685 | 100.00% | 10 of 10 | 40.00% | 4 of 10 |
| CHR06P010694062 | 17 | 2.27 | 80.00% | 8 of 10 | 70.00% | 7 of 10 |
| CHR06P026333318 | 18 | 2.18 | 100.00% | 10 of 10 | 100.00% | 10 of 10 |
| CHR08P102460854 | 19 | 1.06 | 90.00% | 9 of 10 | 90.00% | 9 of 10 |
| CHR08P102461254 | 20 | 1.255 | 90.00% | 9 of 10 | 80.00% | 8 of 10 |
| CHR08P102461554 | 21 | 1.375 | 90.00% | 9 of 10 | 90.00% | 9 of 10 |
| CHR09P000107988 | 22 | 1.33 | 100.00% | 10 of 10 | 50.00% | 5 of 10 |
| CHR09P021958839 | 23 | 1.405 | 90.00% | 9 of 10 | 90.00% | 9 of 10 |
| CHR09P131048752 | 24 | 2.51 | 90.00% | 9 of 10 | 90.00% | 9 of 10 |
| CHR10P118975684 | 25 | 1.265 | 60.00% | 6 of 10 | 90.00% | 9 of 10 |
| CHR11P021861414 | 26 | 4.58 | 100.00% | 10 of 10 | 100.00% | 10 of 10 |
| CHR12P004359362 | 27 | 2.055 | 40.00% | 4 of 10 | 100.00% | 10 of 10 |
| CHR12P016001231 | 28 | 0.72 | 100.00% | 9 of 9 | 60.00% | 6 of 10 |
| CHR14P018893344 | 29 | 1.52 | 90.00% | 9 of 10 | 88.89% | 8 of 9 |
| CHR14P093230340 | 30 | 1.85 | 70.00% | 7 of 10 | 88.89% | 8 of 9 |
| CHR16P000373719 | 31 | 1.585 | 88.89% | 8 of 9 | 50.00% | 4 of 8 |
| CHR16P066389027 | 32 | 1.945 | 100.00% | 10 of 10 | 77.78% | 7 of 9 |
| CHR16P083319654 | 33 | 2.525 | 90.00% | 9 of 10 | 62.50% | 5 of 8 |
| CHR18P019705147 | 34 | 4.07 | 70.00% | 7 of 10 | 100.00% | 9 of 9 |
| CHR19P018622408 | 35 | 1.7 | 90.00% | 9 of 10 | 40.00% | 4 of 10 |
| CHR19P051892823 | 36 | 2.7 | 57.14% | 4 of 7 | 100.00% | 6 of 6 |
| CHRXP013196410 | 37 | 0.68 | 100.00% | 10 of 10 | 66.67% | 6 of 9 |
| CHRXP013196870 | 38 | 0.905 | 80.00% | 8 of 10 | 80.00% | 8 of 10 |
| ha1p16__00179__l50 | 39 | 1.375 | 90.00% | 9 of 10 | 80.00% | 8 of 10 |
| ha1p16__00182__l50 | 40 | 0.92 | 88.89% | 8 of 9 | 80.00% | 8 of 10 |
| ha1p16__00257__l50 | 41 | 0.95 | 100.00% | 10 of 10 | 88.89% | 8 of 9 |
| ha1p__12601__l50 | 42 | 0.745 | 100.00% | 10 of 10 | 77.78% | 7 of 9 |
| ha1p__17147__l50 | 43 | 1.74 | 100.00% | 9 of 9 | 90.00% | 9 of 10 |
| ha1p__42350__l50 | 44 | 1.54 | 80.00% | 8 of 10 | 88.89% | 8 of 9 |

TABLE 26-continued

Sensitivity and Specificity of differentially methylated loci in renal tumors relative to adjacent histological normal renal tissue.

| Feature Name | Locus Number | Threshold | Sensitivity | Pos. of Total | Specificity | Neg. of Total |
|---|---|---|---|---|---|---|
| ha1p__44897__150 | 45 | 4.92 | 40.00% | 4 of 10 | 88.89% | 8 of 9 |
| ha1p__61253__150 | 46 | 1.96 | 80.00% | 8 of 10 | 70.00% | 7 of 10 |
| CHR01P001005050 | 47 | 2.8 | 100.00% | 8 of 8 | 80.00% | 8 of 10 |
| CHR16P001157479 | 48 | 4.66 | 100.00% | 2 of 2 | 100.00% | 1 of 1 |
| ha1g__00681 | 49 | 1.89 | 60% | 6 of 10 | 78% | 7 of 9 |
| ha1g__01966 | 50 | 1.21 | 100% | 10 of 10 | 88% | 7 of 8 |
| ha1g__02153 | 51 | 0.92 | 70% | 7 of 10 | 90% | 9 of 10 |
| ha1g__02319 | 52 | 1.04 | 90% | 9 of 10 | 40% | 4 of 10 |
| ha1g__02335 | 53 | 2.11 | 90% | 9 of 10 | 90% | 9 of 10 |
| ha1p16__00182 | 54 | 0.85 | 89% | 8 of 9 | 90% | 9 of 10 |
| ha1p16__00185 | 55 | 0.53 | 100% | 9 of 9 | 70% | 7 of 10 |
| ha1p16__00193 | 56 | 1.54 | 100% | 7 of 7 | 80% | 8 of 10 |
| ha1p16__00259 | 57 | 1.79 | 100% | 10 of 10 | 90% | 9 of 10 |
| ha1p__02799 | 58 | 3.52 | 60% | 6 of 10 | 100% | 10 of 10 |
| ha1p__03567 | 59 | 1.82 | 50% | 5 of 10 | 80% | 8 of 10 |
| ha1p__03671 | 60 | 0.79 | 60% | 6 of 10 | 80% | 8 of 10 |
| ha1p__05803 | 61 | 1.82 | 70% | 7 of 10 | 70% | 7 of 10 |
| ha1p__07131 | 62 | 6 | 80% | 8 of 10 | 100% | 10 of 10 |
| ha1p__07989 | 63 | 3.3 | 90% | 9 of 10 | 100% | 10 of 10 |
| ha1p__08588 | 64 | 5.67 | 60% | 6 of 10 | 100% | 10 of 10 |
| ha1p__09700 | 65 | 0.98 | 13% | 1 of 8 | 100% | 8 of 8 |
| ha1p__104458 | 66 | 4.06 | 90% | 9 of 10 | 90% | 9 of 10 |
| ha1p__105287 | 67 | 4.48 | 100% | 10 of 10 | 100% | 10 of 10 |
| ha1p__10702 | 68 | 0.95 | 80% | 8 of 10 | 40% | 4 of 10 |
| ha1p__108469 | 69 | 1.63 | 70% | 7 of 10 | 40% | 4 of 10 |
| ha1p__108849 | 70 | 2.75 | 100% | 10 of 10 | 70% | 7 of 10 |
| ha1p__11016 | 71 | 2.71 | 60% | 6 of 10 | 90% | 9 of 10 |
| ha1p__11023 | 72 | 1.67 | 100% | 10 of 10 | 90% | 9 of 10 |
| ha1p__12974 | 73 | 0.57 | 30% | 3 of 10 | 80% | 8 of 10 |
| ha1p__16027 | 74 | 1.99 | 50% | 5 of 10 | 100% | 10 of 10 |
| ha1p__16066 | 75 | 1.52 | 90% | 9 of 10 | 80% | 8 of 10 |
| ha1p__18911 | 76 | 2.16 | 80% | 8 of 10 | 100% | 10 of 10 |
| ha1p__19254 | 77 | 4.53 | 90% | 9 of 10 | 90% | 9 of 10 |
| ha1p__19853 | 78 | 0.5 | 100% | 10 of 10 | 90% | 9 of 10 |
| ha1p__22257 | 79 | 2.11 | 50% | 5 of 10 | 90% | 9 of 10 |
| ha1p__22519 | 80 | 1.47 | 80% | 8 of 10 | 90% | 9 of 10 |
| ha1p__31800 | 81 | 2.46 | 40% | 4 of 10 | 90% | 9 of 10 |
| ha1p__33290 | 82 | 1.09 | 89% | 8 of 9 | 80% | 8 of 10 |
| ha1p__37635 | 83 | 6 | 100% | 10 of 10 | 0% | 0 of 10 |
| ha1p__39189 | 84 | 0.78 | 90% | 9 of 10 | 80% | 8 of 10 |
| ha1p__39511 | 85 | 1.87 | 78% | 7 of 9 | 78% | 7 of 9 |
| ha1p__39752 | 86 | 1.35 | 89% | 8 of 9 | 89% | 8 of 9 |
| ha1p__60945 | 87 | 1.97 | 60% | 6 of 10 | 100% | 10 of 10 |
| ha1p__62183 | 88 | 5.06 | 80% | 8 of 10 | 100% | 10 of 10 |
| ha1p__69418 | 89 | 2.15 | 70% | 7 of 10 | 90% | 9 of 10 |
| ha1p__71224 | 90 | 1.69 | 70% | 7 of 10 | 90% | 9 of 10 |
| ha1p__74221 | 91 | 1.22 | 50% | 5 of 10 | 90% | 9 of 10 |
| ha1p__76289 | 92 | 0.97 | 90% | 9 of 10 | 80% | 8 of 10 |
| ha1p__81050 | 93 | 6 | 80% | 8 of 10 | 100% | 10 of 10 |
| ha1p__81674 | 94 | 1.24 | 100% | 10 of 10 | 30% | 3 of 10 |
| ha1p__86355 | 95 | 1.17 | 78% | 7 of 9 | 50% | 5 of 10 |
| ha1p__98491 | 96 | 4.12 | 80% | 8 of 10 | 80% | 8 of 10 |
| ha1p__99426 | 97 | 0.65 | 90% | 9 of 10 | 90% | 9 of 10 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) adjacent normal samples.
Neg. of Total: Number of negative adjacent normal samples relative to the total number of adjacent normal samples analyzed.

TABLE 27

Sensitivity and Specificity of differentially methylated loci in thyroid tumors relative to adjacent histological normal thyroid tissue.

| Feature Name | Locus Number | Threshold | Sensitivity | Pos. of Total | Specificity | Neg. of Total |
|---|---|---|---|---|---|---|
| CHR01P001976799 | 1 | 6 | 100.00% | 10 of 10 | 0.00% | 0 of 10 |
| CHR01P026794862 | 2 | 1.095 | 66.67% | 2 of 3 | 100.00% | 1 of 1 |

TABLE 27-continued

Sensitivity and Specificity of differentially methylated loci in thyroid tumors relative to adjacent histological normal thyroid tissue.

| Feature Name | Locus Number | Threshold | Sensitivity | Pos. of Total | Specificity | Neg. of Total |
|---|---|---|---|---|---|---|
| CHR01P043164342 | 3 | 2.01 | 100.00% | 10 of 10 | 10.00% | 1 of 10 |
| CHR01P063154999 | 4 | 1.205 | 60.00% | 6 of 10 | 100.00% | 10 of 10 |
| CHR01P204123050 | 5 | 2.795 | 85.71% | 6 of 7 | 50.00% | 3 of 6 |
| CHR01P206905110 | 6 | 1.195 | 60.00% | 6 of 10 | 100.00% | 10 of 10 |
| CHR01P225608458 | 7 | 0.62 | 90.00% | 9 of 10 | 70.00% | 7 of 10 |
| CHR02P005061785 | 8 | 4.49 | 70.00% | 7 of 10 | 90.00% | 9 of 10 |
| CHR02P042255672 | 9 | 3.895 | 100.00% | 10 of 10 | 60.00% | 6 of 10 |
| CHR02P223364582 | 10 | 2.015 | 90.00% | 9 of 10 | 80.00% | 8 of 10 |
| CHR03P027740753 | 11 | 0.77 | 100.00% | 10 of 10 | 90.00% | 9 of 10 |
| CHR03P052525960 | 12 | 3.265 | 90.00% | 9 of 10 | 80.00% | 8 of 10 |
| CHR03P069745999 | 13 | 1.06 | 80.00% | 8 of 10 | 50.00% | 5 of 10 |
| CHR05P059799713 | 14 | 0.55 | 80.00% | 8 of 10 | 40.00% | 4 of 10 |
| CHR05P059799813 | 15 | 0.615 | 70.00% | 7 of 10 | 44.44% | 4 of 9 |
| CHR05P177842690 | 16 | 0.935 | 80.00% | 8 of 10 | 40.00% | 4 of 10 |
| CHR06P010694062 | 17 | 3.58 | 50.00% | 5 of 10 | 80.00% | 8 of 10 |
| CHR06P026333318 | 18 | 2 | 90.00% | 9 of 10 | 90.00% | 9 of 10 |
| CHR08P102460854 | 19 | 0.505 | 10.00% | 1 of 10 | 90.00% | 9 of 10 |
| CHR08P102461254 | 20 | 0.555 | 40.00% | 4 of 10 | 80.00% | 8 of 10 |
| CHR08P102461554 | 21 | 0.545 | 40.00% | 4 of 10 | 70.00% | 7 of 10 |
| CHR09P000107988 | 22 | 1.255 | 60.00% | 6 of 10 | 80.00% | 8 of 10 |
| CHR09P021958839 | 23 | 1.03 | 100.00% | 10 of 10 | 80.00% | 8 of 10 |
| CHR09P131048752 | 24 | 3.27 | 80.00% | 8 of 10 | 88.89% | 8 of 9 |
| CHR10P118975684 | 25 | 0.975 | 90.00% | 9 of 10 | 70.00% | 7 of 10 |
| CHR11P021861414 | 26 | 6 | 90.00% | 9 of 10 | 80.00% | 8 of 10 |
| CHR12P004359362 | 27 | 2.985 | 50.00% | 5 of 10 | 90.00% | 9 of 10 |
| CHR12P016001231 | 28 | 1.21 | 100.00% | 9 of 9 | 20.00% | 2 of 10 |
| CHR14P018893344 | 29 | 1.21 | 70.00% | 7 of 10 | 80.00% | 8 of 10 |
| CHR14P093230340 | 30 | 1.84 | 60.00% | 6 of 10 | 90.00% | 9 of 10 |
| CHR16P000373719 | 31 | 0.965 | 66.67% | 6 of 9 | 77.78% | 7 of 9 |
| CHR16P066389027 | 32 | 2.62 | 80.00% | 8 of 10 | 80.00% | 8 of 10 |
| CHR16P083319654 | 33 | 2.845 | 100.00% | 10 of 10 | 80.00% | 8 of 10 |
| CHR18P019705147 | 34 | 5.775 | 10.00% | 1 of 10 | 100.00% | 10 of 10 |
| CHR19P018622408 | 35 | 2.425 | 80.00% | 8 of 10 | 80.00% | 8 of 10 |
| CHR19P051892823 | 36 | 1.585 | 75.00% | 6 of 8 | 100.00% | 6 of 6 |
| CHRXP013196410 | 37 | 1.445 | 50.00% | 5 of 10 | 80.00% | 8 of 10 |
| CHRXP013196870 | 38 | 1.93 | 30.00% | 3 of 10 | 90.00% | 9 of 10 |
| ha1p16__00179_l50 | 39 | 1.055 | 100.00% | 10 of 10 | 80.00% | 8 of 10 |
| ha1p16__00182_l50 | 40 | 0.645 | 100.00% | 10 of 10 | 80.00% | 8 of 10 |
| ha1p16__00257_l50 | 41 | 0.515 | 88.89% | 8 of 9 | 70.00% | 7 of 10 |
| ha1p__12601_l50 | 42 | 0.66 | 80.00% | 8 of 10 | 40.00% | 4 of 10 |
| ha1p__17147_l50 | 43 | 0.61 | 80.00% | 8 of 10 | 40.00% | 4 of 10 |
| ha1p__42350_l50 | 44 | 3.685 | 70.00% | 7 of 10 | 77.78% | 7 of 9 |
| ha1p__44897_l50 | 45 | 3.565 | 80.00% | 8 of 10 | 90.00% | 9 of 10 |
| ha1p__61253_l50 | 46 | 1.785 | 70.00% | 7 of 10 | 55.56% | 5 of 9 |
| CHR01P001005050 | 47 | 1.4 | 50.00% | 4 of 8 | 75.00% | 6 of 8 |
| CHR16P001157479 | 48 | 6 | 100.00% | 2 of 2 | 0.00% | 0 of 2 |
| ha1g__00681 | 49 | 1.11 | 100.00% | 10 of 10 | 80.00% | 8 of 10 |
| ha1g__01966 | 50 | 2.22 | 70.00% | 7 of 10 | 90.00% | 9 of 10 |
| ha1g__02153 | 51 | 0.59 | 90.00% | 9 of 10 | 80.00% | 8 of 10 |

TABLE 27-continued

Sensitivity and Specificity of differentially methylated loci in thyroid tumors relative to adjacent histological normal thyroid tissue.

| Feature Name | Locus Number | Threshold | Sensitivity | Pos. of Total | Specificity | Neg. of Total |
|---|---|---|---|---|---|---|
| ha1g_02319 | 52 | 0.53 | 70.00% | 7 of 10 | 70.00% | 7 of 10 |
| ha1g_02335 | 53 | 1.61 | 90.00% | 9 of 10 | 80.00% | 8 of 10 |
| ha1p16_00182 | 54 | 0.67 | 100.00% | 10 of 10 | 80.00% | 8 of 10 |
| ha1p16_00185 | 55 | 0.75 | 90.00% | 9 of 10 | 80.00% | 8 of 10 |
| ha1p16_00193 | 56 | 2.12 | 80.00% | 8 of 10 | 100.00% | 10 of 10 |
| ha1p16_00259 | 57 | 1.23 | 100.00% | 10 of 10 | 70.00% | 7 of 10 |
| ha1p_02799 | 58 | 3.75 | 55.56% | 5 of 9 | 70.00% | 7 of 10 |
| ha1p_03567 | 59 | 2.52 | 66.67% | 6 of 9 | 70.00% | 7 of 10 |
| ha1p_03671 | 60 | 1.21 | 20.00% | 2 of 10 | 100.00% | 10 of 10 |
| ha1p_05803 | 61 | 2.13 | 100.00% | 10 of 10 | 50.00% | 5 of 10 |
| ha1p_07131 | 62 | 6 | 80.00% | 8 of 10 | 90.00% | 9 of 10 |
| ha1p_07989 | 63 | 4.73 | 80.00% | 8 of 10 | 80.00% | 8 of 10 |
| ha1p_08588 | 64 | 5.31 | 30.00% | 3 of 10 | 100.00% | 10 of 10 |
| ha1p_09700 | 65 | 0.77 | 11.11% | 1 of 9 | 100.00% | 9 of 9 |
| ha1p_104458 | 66 | 4.53 | 50.00% | 5 of 10 | 80.00% | 8 of 10 |
| ha1p_105287 | 67 | 3.69 | 50.00% | 5 of 10 | 80.00% | 8 of 10 |
| ha1p_10702 | 68 | 0.57 | 40.00% | 4 of 10 | 90.00% | 9 of 10 |
| ha1p_108469 | 69 | 1.02 | 50.00% | 5 of 10 | 77.78% | 7 of 9 |
| ha1p_108849 | 70 | 3.36 | 50.00% | 5 of 10 | 100.00% | 9 of 9 |
| ha1p_11016 | 71 | 4.1 | 50.00% | 5 of 10 | 100.00% | 9 of 9 |
| ha1p_11023 | 72 | 2.64 | 66.67% | 6 of 9 | 55.56% | 5 of 9 |
| ha1p_12974 | 73 | 1.5 | 40.00% | 4 of 10 | 100.00% | 10 of 10 |
| ha1p_16027 | 74 | 1.27 | 80.00% | 8 of 10 | 100.00% | 10 of 10 |
| ha1p_16066 | 75 | 1.2 | 66.67% | 6 of 9 | 100.00% | 9 of 9 |
| ha1p_18911 | 76 | 3.67 | 40.00% | 4 of 10 | 80.00% | 8 of 10 |
| ha1p_19254 | 77 | 3.55 | 90.00% | 9 of 10 | 60.00% | 6 of 10 |
| ha1p_19853 | 78 | 0.5 | 90.00% | 9 of 10 | 50.00% | 5 of 10 |
| ha1p_22257 | 79 | 1.29 | 50.00% | 5 of 10 | 80.00% | 8 of 10 |
| ha1p_22519 | 80 | 2.52 | 40.00% | 4 of 10 | 100.00% | 10 of 10 |
| ha1p_31800 | 81 | 3.25 | 55.56% | 5 of 9 | 90.00% | 9 of 10 |
| ha1p_33290 | 82 | 1.68 | 44.44% | 4 of 9 | 77.78% | 7 of 9 |
| ha1p_37635 | 83 | 4.19 | 80.00% | 8 of 10 | 50.00% | 5 of 10 |
| ha1p_39189 | 84 | 0.9 | 44.44% | 4 of 9 | 80.00% | 8 of 10 |
| ha1p_39511 | 85 | 0.76 | 80.00% | 8 of 10 | 50.00% | 5 of 10 |
| ha1p_39752 | 86 | 3.14 | 80.00% | 8 of 10 | 40.00% | 4 of 10 |
| ha1p_60945 | 87 | 1.9 | 70.00% | 7 of 10 | 60.00% | 6 of 10 |
| ha1p_62183 | 88 | 4.53 | 60.00% | 6 of 10 | 100.00% | 10 of 10 |
| ha1p_69418 | 89 | 5.38 | 90.00% | 9 of 10 | 100.00% | 10 of 10 |
| ha1p_71224 | 90 | 0.91 | 90.00% | 9 of 10 | 60.00% | 6 of 10 |
| ha1p_74221 | 91 | 1.58 | 100.00% | 10 of 10 | 60.00% | 6 of 10 |
| ha1p_76289 | 92 | 1.29 | 40.00% | 4 of 10 | 90.00% | 9 of 10 |
| ha1p_81050 | 93 | 5.86 | 70.00% | 7 of 10 | 100.00% | 10 of 10 |
| ha1p_81674 | 94 | 1.36 | 70.00% | 7 of 10 | 80.00% | 8 of 10 |
| ha1p_86355 | 95 | 0.9 | 70.00% | 7 of 10 | 80.00% | 8 of 10 |
| ha1p_98491 | 96 | 5.45 | 50.00% | 5 of 10 | 90.00% | 9 of 10 |
| ha1p_99426 | 97 | 0.66 | 60.00% | 6 of 10 | 80.00% | 8 of 10 |

Threshold: Average dCt value established by ROC curve analysis as optimal threshold for distinguishing tumor and adjacent normal tissues.
Sensitivity: % of positive (i.e., methylation score above Threshold for gain of methylation markers or below Threshold for loss of methylation markers) tumors.
Pos. of Total: Number of positive tumors relative to the total number of tumors analyzed.
Specificity: % of negative (i.e., methylation score below Threshold for gain of methylation markers or above Threshold for loss of methylation markers) adjacent normal samples.
Neg. of Total: Number of negative adjacent normal samples relative to the total number of adjacent normal samples analyzed.

Although the invention has been described in some detail by way of illustration and example for purposes of clarity of understanding, it will be readily apparent to one of ordinary skill in the art in light of the teachings of this invention that certain changes and modifications may be made thereto without departing from the spirit or scope of the appended claims.

All publications, databases, Genbank sequences, patents, and patent applications cited in this specification are herein incorporated by reference as if each was specifically and individually indicated to be incorporated by reference.

SEQUENCE LISTING (485 sequences)

SEQ ID NO: 1 - DNA, 50 bp, Artificial Sequence
  Locus number 1 Feature name CHR01P001976799
ggcgtttgctttggtttcatggccggttttatcagcagttactggacagg

SEQ ID NO: 2 - DNA, 50 bp, Artificial Sequence
  Locus number 2 Feature name CHR01P026794862
agcaagaaggagatgccgcccaccaaccccatccgcctgggcctggccct

SEQ ID NO: 3 - DNA, 50 bp, Artificial Sequence
  Locus number 3 Feature name CHR01P043164342
gcccctccccccaggtcacactttcctccaccaacaaacacccctctgac

SEQ ID NO: 4 - DNA, 50 bp, Artificial Sequence
  Locus number 4 Feature name CHR01P063154999
accctttgagactcagaaactttttatccacatacaccctttatcacatt

SEQ ID NO: 5 - DNA, 50 bp, Artificial Sequence
  Locus number 5 Feature name CHR01P204123050
gtgtggtacgtaagcgggtatctacctctcctgaaagccttttctcttcc

SEQ ID NO: 6 - DNA, 50 bp, Artificial Sequence
  Locus number 6 Feature name CHR01P206905110
gtgttctgccgttctttctccagatcgcctgaaagctcctcttgaatgtg

SEQ ID NO: 7 - DNA, 50 bp, Artificial Sequence
  Locus number 7 Feature name CHR01P225608458
gcgctgggaacctgagcctgcacaacccactagaaagcacccgtgaccgt

SEQ ID NO: 8 - DNA, 50 bp, Artificial Sequence
  Locus number 8 Feature name CHR02P005061785
gcagccggttactcgagggtagggcgtctagagcagccggttacgcgagg

SEQ ID NO: 9 - DNA, 50 bp, Artificial Sequence
  Locus number 9 Feature name CHR02P042255672
gagaaaagcagtgagcagtcttttcttgtgcccctcagatctgcctgagc

SEQ ID NO: 10 - DNA, 50 bp, Artificial Sequence
  Locus number 10 Feature name CHR02P223364582
accgacgctgaaactgctcgacatcggactcccagacccagacctccttt

SEQ ID NO: 11 - DNA, 50 bp, Artificial Sequence
  Locus number 11 Feature name CHR03P027740753
aagctggtactgagcgcgttctgccctgcgcttcctgcgttttgtgtcat

SEQ ID NO: 12 - DNA, 50 bp, Artificial Sequence
  Locus number 12 Feature name CHR03P052525960
cgacaggctttccaacaaaattcctctttcctgcgcagaaccgctctcca

SEQ ID NO: 13 - DNA, 50 bp, Artificial Sequence
  Locus number 13 Feature nameCHR03P069745999
aaagctaatggttggcattaatcttgggaattcagacctattccgctcca

SEQ ID NO: 14 - DNA, 50 bp, Artificial Sequence
  Locus number 14 Feature name CHR05P059799713
ctcaattacgactacatatgcattaaggcaggaactggcaggcctcaggg

SEQ ID NO: 15 - DNA, 50 bp, Artificial Sequence
  Locus number 15 Feature name CHR05P059799813
aaactgagctccagagccagccaatcacttagctcctcataacaagtcta

SEQ ID NO: 16 - DNA, 50 bp, Artificial Sequence
  Locus number 16 Feature name CHR05P177842690
ggagcacggcttcaatgctgcacctctgtgtgcgccggagcacggcttca

SEQ ID NO: 17 - DNA, 50 bp, Artificial Sequence
  Locus number 17 Feature name CHR06P010694062
aggattaaaggattcaggaaagcaagcagccctccggagaagctgtcgaa

SEQ ID NO: 18 - DNA, 50 bp, Artificial Sequence
  Locus number 18 Feature name CHR06P026333318
gggcaaaccaatcttcctaactcatttactttgcagatgaactatggcgc

SEQ ID NO: 19 - DNA, 50 bp, Artificial Sequence
  Locus number 19 Feature name CHR08P102460854
ttctggttgacttgggatacctgagctcggctctcattagctcttccgct

SEQ ID NO: 20 - DNA, 50 bp, Artificial Sequence
  Locus number 20 Feature name CHR08P102461254
agttacctgtggccgcccaagtccgccactttctgctctgtgtctgccca

SEQ ID NO: 21 - DNA, 50 bp, Artificial Sequence
  Locus number 21 Feature name CHR08P102461554
agcggagcaagttcattggatcaaacatgtcacaagagtcggacaagtaa

SEQ ID NO: 22 - DNA, 50 bp, Artificial Sequence
  Locus number 22 Feature name CHR09P000107988
tggctcgccgcctcctcctcgtcttcatcttcctcctctcccaggacatc

SEQ ID NO: 23 - DNA, 50 bp, Artificial Sequence
  Locus number 23 Feature name CHR09P021958839
atgggctccagctcgccgttcggttctcccgaggcagcatttacacttga

SEQ ID NO: 24 - DNA, 50 bp, Artificial Sequence
  Locus number 24 Feature name CHR09P131048752
gctctctgcggcctgcagctgtcctctgaaagatacagaccagccagaat

SEQ ID NO: 25 - DNA, 50 bp, Artificial Sequence
  Locus number 25 Feature name CHR10P118975684
gagtccttcctccgcctcaaaaaggcaggacagtcagcttattagccgct

SEQ ID NO: 26 - DNA, 50 bp, Artificial Sequence
  Locus number 26 Feature name CHR11P021861414
ccatgcccatgaggagctagacttccaaatttcttccacacctttagaaa

SEQ ID NO: 27 - DNA, 50 bp, Artificial Sequence
  Locus number 27 Feature name CHR12P004359362
tgggctgtctgttgacctgtcccacttccatcaggaaatgtgaaggcagc

SEQ ID NO: 28 - DNA, 50 bp, Artificial Sequence
  Locus number 28 Feature name CHR12P016001231
caggtaagggttcttcttgagcattctgtgcctgtattttacaatgcatg

SEQ ID NO: 29 - DNA, 50 bp, Artificial Sequence
  Locus number 29 Feature name CHR14P018893344
cctcacccgacagctggcagccgcctgcctccagcttcaagtcacacccg

SEQ ID NO: 30 - DNA, 50 bp, Artificial Sequence
  Locus number 30 Feature name CHR14P093230340
gcccgcgtgctgcgccgagacctcagccgtcctcactgagcggaatggtt

SEQ ID NO: 31 - DNA, 50 bp, Artificial Sequence
  Locus number 31 Feature name CHR16P000373719
tgtctggaatgatccagcaccggctacactggttgaccttggaggaggag

SEQ ID NO: 32 - DNA, 50 bp, Artificial Sequence
  Locus number 32 Feature name CHR16P066389027
ccgcatatggtcttgtatctgacagtccctgtgtctcacagcggtaatcg

SEQ ID NO: 33 - DNA, 50 bp, Artificial Sequence
  Locus number 33 Feature name CHR16P083319654
actcaaatcccaacagatgaaagggaggagagactgacagatgcagtgcc

SEQ ID NO: 34 - DNA, 50 bp, Artificial Sequence
  Locus number 34 Feature name CHR18P019705147
ggagtttagacccagccaggtaacgtccttttaagttttggtttgtgata

SEQ ID NO: 35 - DNA, 50 bp, Artificial Sequence
  Locus number 35 Feature name CHR19P018622408
atgtttatactccacgtgagtcacttgcacagatgacgggtgatgttttc

SEQ ID NO: 36 - DNA, 50 bp, Artificial Sequence
  Locus number 36 Feature name CHR19P051892823
actcaccagcgtgtccttgttgctgtaatgaaccacccaaccctcccgca

SEQ ID NO: 37 - DNA, 50 bp, Artificial Sequence
  Locus number 37 Feature name CHRXP013196410
agtattttcctcggctgcagtttccatggctggcttcataccatccacca

SEQ ID NO: 38 - DNA, 50 bp, Artificial Sequence
  Locus number 38 Feature name CHRXP013196870
cccacctcatttcttctagccaagtacacccaatgaatgctaattaattc

SEQ ID NO: 39 - DNA, 50 bp, Artificial Sequence
  Locus number 39 Feature name ha1p16_00179_l50
tgtgctctggcttctgccttcctctctaatctcgttgcgtatgggctcca

SEQ ID NO: 40 - DNA, 50 bp, Artificial Sequence
  Locus number 40 Feature name ha1p16_00182_l50
tctttagcttctcctcctattcacacttcatatttacccattgcattggt

SEQ ID NO: 41 - DNA, 50 bp, Artificial Sequence
  Locus number 41 Feature name ha1p16_00257_l50
tttggtccaccaagccctatcgttctgctctttggaaattctccctcact

SEQ ID NO: 42 - DNA, 50 bp, Artificial Sequence
  Locus number 42 Feature name ha1p_12601_l50
gcgagggcttggctgctgtttctaaatgcagtgtttttttgttccctttc

SEQ ID NO: 43 - DNA, 50 bp, Artificial Sequence
  Locus number 43 Feature name ha1p_17147_l50
aattgctctaactgatttatttgtccacaaagagacgccacctacctgct

SEQ ID NO: 44 - DNA, 50 bp, Artificial Sequence
  Locus number 44 Feature name ha1p_42350_l50
gaccatctggttagtccttgtttactgcacaccctgccagtttgagctta

SEQ ID NO: 45 - DNA, 50 bp, Artificial Sequence
  Locus number 45 Feature name ha1p_44897_l50
ctgcgagcctaagatggcaggcaggattagccgtgcttgtgctgtgtgtg

SEQ ID NO: 46 - DNA, 50 bp, Artificial Sequence
  Locus number 46 Feature name ha1p_61253_l50
gaggcggtattcctgacgtttggatttaggctgataagtgacagtgagtt

SEQ ID NO: 47 - DNA, 50 bp, Artificial Sequence
  Locus number 47 Feature name chr01p001005050
gttcttgccgcctacctgacagcaggccttctagaaagttctctccagaa

SEQ ID NO: 48 - DNA, 50 bp, Artificial Sequence
  Locus number 48 Feature name chr16p001157479
gagcttggtgcggttgccatgggaacctgttgctaatgaatctctggggt

SEQ ID NO: 49 - DNA, 60 bp, Artificial Sequence
  Locus number 49 Feature name ha1g_00681
tcgtagtaggtcgctttttgcatcgcgttgtttcacgatcttgatcgcacactctgacag

SEQ ID NO: 50 - DNA, 60 bp, Artificial Sequence
  Locus number 50 Feature name ha1g_01966
gaacttgaaggatgttggatgcgtctgggaaccggccattgccacttagtagtatgttgt

SEQ ID NO: 51 - DNA, 60 bp, Artificial Sequence
  Locus number 51 Feature name ha1g_02153
ccgaatctgtagtgtggctggtatcggtgttcccctggtttaactagcctgtttggtaag

SEQ ID NO: 52 - DNA, 60 bp, Artificial Sequence
  Locus number 52 Feature name ha1g_02319
catttcggtactgtttccccgagatcaggaactttccgggtctaggagcaacgcctggag

SEQ ID NO: 53 - DNA, 60 bp, Artificial Sequence
  Locus number 53 Feature name ha1g_02335
gtagcggttgaagtggaactccttctccagctccagtgtctggtagcgcgtgtaggtctg

SEQ ID NO: 54 - DNA, 60 bp, Artificial Sequence
  Locus number 54 Feature name ha1p16_00182
ctccgaccactctttagcttctcctcctattcacacttcatatttacccattgcattggt

SEQ ID NO: 55 - DNA, 60 bp, Artificial Sequence
  Locus number 55 Feature name ha1p16_00185
ctcctcaggctttttgctcagccctggaaccgcgctgtaattggcagctccttctaaatc

SEQ ID NO: 56 - DNA, 60 bp, Artificial Sequence
  Locus number 56 Feature name ha1p16_00193
cactagacctctagcctcttgagtcttcattgctccgcagtctaggccttgaactagcag

SEQ ID NO: 57 - DNA, 60 bp, Artificial Sequence
  Locus number 57 Feature name ha1p16_00259
gtcactggaaaaatactacgggccactctctataccatcctgcacccccagatggagaaa

SEQ ID NO: 58 - DNA, 60 bp, Artificial Sequence
  Locus number 58 Feature name ha1p_02799
tcaacatcagtatttcctgtcctggggacaaaccagtgcctcatgtttctggaaacgctg

SEQ ID NO: 59 - DNA, 60 bp, Artificial Sequence
  Locus number 59 Feature name ha1p_03567
cctatcaaattacgcgcaatggaaacatcttagtcctcagagcaatcctgggtgcaaggc

SEQ ID NO: 60 - DNA, 60 bp, Artificial Sequence
  Locus number 60 Feature name ha1p_03671
atgcctccttgcctctggagactcttgttggttggagcagtagttggcactttaatgttt

SEQ ID NO: 61 - DNA, 60 bp, Artificial Sequence
  Locus number 61 Feature name ha1p_05803
atgccaggaagcatttcagagcggaaggtcatcggcatgagaactgggtattaggatttg

SEQ ID NO: 62 - DNA, 60 bp, Artificial Sequence
  Locus number 62 Feature name ha1p_07131
aataaacagtcagccacaacactctgtggtcccagcatctaagacaagacttgacacccc

SEQ ID NO: 63 - DNA, 60 bp, Artificial Sequence
  Locus number 63 Feature name ha1p_07989
agccaatcatttgaaactcactgtgaatcccatccgctacacactttgtaccaccaacat

SEQ ID NO: 64 - DNA, 60 bp, Artificial Sequence
  Locus number 64 Feature name ha1p_08588
gacagggcaatgaccagtgtgaggtcaagggatgtcgtgctcagcttgatttgggaggtg

SEQ ID NO: 65 - DNA, 60 bp, Artificial Sequence
  Locus number 65 Feature name ha1p_09700
atctgaggaaagtacagaacaactgtgggaaagccagtctcttcaaatgaacagcgatgt

SEQ ID NO: 66 - DNA, 60 bp, Artificial Sequence
  Locus number 66 Feature name ha1p_104458
ccctggttgggtaggaagtcaggatcgcctagatggagctatggagaataaacagagcag

SEQ ID NO: 67 - DNA, 60 bp, Artificial Sequence
  Locus number 67 Feature name ha1p_105287
tccaccaggcaaaacacatcatctaaggaaaagaagtgaggtcggaacaccaacgcatca

SEQ ID NO: 68 - DNA, 60 bp, Artificial Sequence
  Locus number 68 Feature name ha1p_10702
agggacagacaggaaggaaaacagaccgagagagatcagttttgagatccaggaactgct

SEQ ID NO: 69 - DNA, 60 bp, Artificial Sequence
  Locus number 69 Feature name ha1p_108469
gcgtgtatttgtgattctgcctggcttgtttccattcatccttcatgcttcagctcagct

SEQ ID NO: 70 - DNA, 60 bp, Artificial Sequence
  Locus number 70 Feature name ha1p_108849
catgctcaaaccttcttccaacattcagtcgtaagtcgaattgcctgtgacagagatact

SEQ ID NO: 71 - DNA, 60 bp, Artificial Sequence
  Locus number 71 Feature name ha1p_11016
aactgtccctatcttcaccagcctgccctcaaatcattggttcaaatcgctgtcgagaag

SEQ ID NO: 72 - DNA, 60 bp, Artificial Sequence
  Locus number 72 Feature name ha1p_11023
catgtcctttatgaccctctgtgatgcacccacctcctggtctccgcactcagcattctg

SEQ ID NO: 73 - DNA, 60 bp, Artificial Sequence
  Locus number 73 Feature name ha1p_12974
acagtggtttccttggttgccattccctttcttcttcattgggagtattctgcggtgaac

SEQ ID NO: 74 - DNA, 60 bp, Artificial Sequence
  Locus number 74 Feature name ha1p_16027
tagtcttcgctcaacctgatttggctctgctggcagcctcgtccttcgccatcgaacatt

SEQ ID NO: 75 - DNA, 60 bp, Artificial Sequence
  Locus number 75 Feature name ha1p_16066
aaaggcatcccatctggaacaaaatcagaaagctattggcaaaggtaatcaatcaggcca

SEQ ID NO: 76 - DNA, 60 bp, Artificial Sequence
  Locus number 76 Feature name ha1p_18911
tcacgctttagaccataaatcagcagttgccttttcagcgaaggatcacagtatggagat

SEQ ID NO: 77 - DNA, 60 bp, Artificial Sequence
  Locus number 77 Feature name ha1p_19254
agtgcttgatgatggtgctaaattgggccttgatataggaaggcacaggaatctctagca

SEQ ID NO: 78 - DNA, 60 bp, Artificial Sequence
  Locus number 78 Feature name ha1p_19853
agccaaaaaagatttgtcttcaatgagccttttgtctccacctctagctttctcgaccct

SEQ ID NO: 79 - DNA, 60 bp, Artificial Sequence
  Locus number 79 Feature name ha1p_22257
ccttcgcttcaaagactgcttggcttcctttcggtggattagtcaagatgttttgctgac

SEQ ID NO: 80 - DNA, 60 bp, Artificial Sequence
  Locus number 80 Feature name ha1p_22519
tgtttggatgatgggacacatcaccctgggaactgtctcaaagcacaaccacatcttagg

SEQ ID NO: 81 - DNA, 60 bp, Artificial Sequence
  Locus number 81 Feature name ha1p_31800
agggccttcctgtgttagtcagtctttcctgatcttcacatttctttagccacagatgat

SEQ ID NO: 82 - DNA, 60 bp, Artificial Sequence
  Locus number 82 Feature name ha1p_33290
tccagagtattttccccttgcccttcattccagagtattttgcttgcacctctttcccat

SEQ ID NO: 83 - DNA, 60 bp, Artificial Sequence
  Locus number 83 Feature name ha1p_37635
tgcccttgaaccaggagcgaaactgagctatctaaggaaaacactgtgagcaaatactga

SEQ ID NO: 84 - DNA, 60 bp, Artificial Sequence
  Locus number 84 Feature name ha1p_39189
accctacagcagactctctaccactaccgagtgatacaaaggactgggattctggacagg

SEQ ID NO: 85 - DNA, 60 bp, Artificial Sequence
  Locus number 85 Feature name ha1p_39511
ggttggcattccagtcttaaagagtcaacctctcccagcttcactgatgtgtgatggcat

SEQ ID NO: 86 - DNA, 60 bp, Artificial Sequence
  Locus number 86 Feature name ha1p_39752
tagtgtgctatgacattccaacctgagcagaatcctccaggagaatccagagtctccagc

SEQ ID NO: 87 - DNA, 60 bp, Artificial Sequence
  Locus number 87 Feature name ha1p_60945
ttctgggtttagggttcccaggcaatagcagggtgttttctcatgcctagactcatgcag

SEQ ID NO: 88 - DNA, 60 bp, Artificial Sequence
  Locus number 88 Feature name ha1p_62183
gccattcctagtcacagaaggtccccagcaagagcatttgatggacatctgtccttccag

SEQ ID NO: 89 - DNA, 60 bp, Artificial Sequence
  Locus number 89 Feature name ha1p_69418
tgcgaggcacagtcctgggttctaggcatacacgtttgaaaaggtacagataatctagca

SEQ ID NO: 90 - DNA, 60 bp, Artificial Sequence
  Locus number 90 Feature name ha1p_71224
cttattcactaggccgtctacaaaggttgtggggcaaaagactgtttcccagctctgtct

SEQ ID NO: 91 - DNA, 60 bp, Artificial Sequence
  Locus number 91 Feature name ha1p_74221
gaagatccgagggtcacactacgtgacttctgggtgtctgtgggtactgctgtgggaaca

SEQ ID NO: 92 - DNA, 60 bp, Artificial Sequence
  Locus number 92 Feature name ha1p_76289
gaaacaggaatagcaaggcgacagcagacccgcacagaggcaggagaacgagattccgag

SEQ ID NO: 93 - DNA, 60 bp, Artificial Sequence
  Locus number 93 Feature name ha1p_81050
ctcagagaacaacactcaccggaacatggcttactaaagggcagggatagggtattgcag

SEQ ID NO: 94 - DNA, 60 bp, Artificial Sequence
  Locus number 94 Feature name ha1p_81674
ctttcggtctcctccccattttcctagtcgtcttcggttgtggatgttgtaaactcgacc

SEQ ID NO: 95 - DNA, 60 bp, Artificial Sequence
  Locus number 95 Feature name ha1p_86355
tttccagtaaacgaccatccatgtctccctacggtgaatcacagttgacaagcccagttc

SEQ ID NO: 96 - DNA, 60 bp, Artificial Sequence
  Locus number 96 Feature name ha1p_98491
atcaagtaaggcttgtttaaggcgatccttgtgcggcaggaagtcagagatgggagagat

SEQ ID NO: 97 - DNA, 60 bp, Artificial Sequence
  Locus number 97 Feature name ha1p_99426
gagggaaactagaatcctgaagagttccatcctgtccaactgcccacacaacgagccacg

SEQ ID NO: 98 - DNA, 23 bp, Artificial Sequence
  Locus number 1 left primer
tagcgtcgggtattgaaggagag

SEQ ID NO: 99 - DNA, 23 bp, Artificial Sequence
  Locus number 2 left primer
tggacatcagcaagaaggagatg

SEQ ID NO: 100 - DNA, 23 bp, Artificial Sequence
  Locus number 3 left primer
ccaccagtcagaaccagtcattg

SEQ ID NO: 101 - DNA, 23 bp, Artificial Sequence
  Locus number 4 left primer
gtctcgcttcttccgtctctgtc

SEQ ID NO: 102 - DNA, 23 bp, Artificial Sequence
  Locus number 5 left primer
cttagtaagttgcgtggatgggc

SEQ ID NO: 103 - DNA, 23 bp, Artificial Sequence
  Locus number 6 left primer
cataccttgctgtgtgttctgcc

SEQ ID NO: 104 - DNA, 23 bp, Artificial Sequence
  Locus number 7 left primer
tttgaactgaccaactgggagac

SEQ ID NO: 105 - DNA, 23 bp, Artificial Sequence
  Locus number 8 left primer
ccagtgggtgaggagagtcaaac

SEQ ID NO: 106 - DNA, 23 bp, Artificial Sequence
  Locus number 9 left primer
atgcaacttcagggaagagatgc

SEQ ID NO: 107 - DNA, 23 bp, Artificial Sequence
  Locus number 10 left primer
ttacgcaccttcacaaacctcag

SEQ ID NO: 108 - DNA, 23 bp, Artificial Sequence
  Locus number 11 left primer
cacaacagatgagatggccaaag

SEQ ID NO: 109 - DNA, 23 bp, Artificial Sequence
  Locus number 12 left primer
tagtcctggtgctctcctttccc

SEQ ID NO: 110 - DNA, 23 bp, Artificial Sequence
  Locus number 13 left primer
accatctagcacctccctccttc

SEQ ID NO: 111 - DNA, 23 bp, Artificial Sequence
  Locus number 14 left primer
ttaacctgctcctgttggacctc

SEQ ID NO: 112 - DNA, 23 bp, Artificial Sequence
  Locus number 15 left primer
ttaacctgctcctgttggacctc

SEQ ID NO: 113 - DNA, 23 bp, Artificial Sequence
  Locus number 16 left primer
cttcaatccacctctgtgtgtgc

SEQ ID NO: 114 - DNA, 23 bp, Artificial Sequence
  Locus number 17 left primer
aatgctgtggctcctaaggactg

SEQ ID NO: 115 - DNA, 23 bp, Artificial Sequence
  Locus number 18 left primer
ctttgcaggtcatggtctacgtg

SEQ ID NO: 116 - DNA, 23 bp, Artificial Sequence
  Locus number 19 left primer
cgcatttgattctggttgacttg

SEQ ID NO: 117 - DNA, 23 bp, Artificial Sequence
  Locus number 20 left primer
aactgaccctcagctctcacagg

SEQ ID NO: 118 - DNA, 23 bp, Artificial Sequence
  Locus number 21 left primer
actcgggtaaacttcggagtgag

SEQ ID NO: 119 - DNA, 22 bp, Artificial Sequence
  Locus number 22 left primer
attgtcgaacatgtcctgggag

SEQ ID NO: 120 - DNA, 24 bp, Artificial Sequence
  Locus number 23 left primer
ggataaagttctcgcaatggcttc

SEQ ID NO: 121 - DNA, 23 bp, Artificial Sequence
  Locus number 24 left primer
ctcacactgacactgaactccgc

SEQ ID NO: 122 - DNA, 23 bp, Artificial Sequence
  Locus number 25 left primer
taaagaaagtgaagcagaggcgg

SEQ ID NO: 123 - DNA, 23 bp, Artificial Sequence
  Locus number 26 left primer
acctgcactaccttcaacttggc

SEQ ID NO: 124 - DNA, 23 bp, Artificial Sequence
  Locus number 27 left primer
gtggctgtgtacaggtggatcag

SEQ ID NO: 125 - DNA, 23 bp, Artificial Sequence
  Locus number 28 left primer
aatacaagtgaatcacccggcag

SEQ ID NO: 126 - DNA, 23 bp, Artificial Sequence
  Locus number 29 left primer
tgggcttctttacatcttccctg

SEQ ID NO: 127 - DNA, 23 bp, Artificial Sequence
  Locus number 30 left primer
gcataaggtctatttgccgttcg

SEQ ID NO: 128 - DNA, 23 bp, Artificial Sequence
  Locus number 31 left primer
aggaagaacggtgtgttcaaagc

SEQ ID NO: 129 - DNA, 23 bp, Artificial Sequence
  Locus number 32 left primer
tgggagtcgaagttgaaaggaag

SEQ ID NO: 130 - DNA, 23 bp, Artificial Sequence
  Locus number 33 left primer
ctgcactcaaatcccaacagatg

SEQ ID NO: 131 - DNA, 23 bp, Artificial Sequence
  Locus number 34 left primer
ctctggatttccaccctcctacc

SEQ ID NO: 132 - DNA, 23 bp, Artificial Sequence
  Locus number 35 left primer
ggactgaagttcgagttggaagc

SEQ ID NO: 133 - DNA, 23 bp, Artificial Sequence
  Locus number 36 left primer
ttccctaactcctgcccgtagtc

SEQ ID NO: 134 - DNA, 23 bp, Artificial Sequence
  Locus number 37 left primer
agtttccatggctggcttcatac

SEQ ID NO: 135 - DNA, 23 bp, Artificial Sequence
  Locus number 38 left primer
agtttccatggctggcttcatac

SEQ ID NO: 136 - DNA, 24 bp, Artificial Sequence
  Locus number 39 left primer
ggataaagttctcgcaatggcttc

SEQ ID NO: 137 - DNA, 23 bp, Artificial Sequence
  Locus number 40 left primer
gtctcagtggttgctcacaatgc

SEQ ID NO: 138 - DNA, 23 bp, Artificial Sequence
  Locus number 41 left primer
gatggaaacgttctttggtccac

SEQ ID NO: 139 - DNA, 23 bp, Artificial Sequence
  Locus number 42 left primer
cttgaccagacggacttctctcc

SEQ ID NO: 140 - DNA, 23 bp, Artificial Sequence
  Locus number 43 left primer
caaattccgtgttcagatccctc

SEQ ID NO: 141 - DNA, 23 bp, Artificial Sequence
  Locus number 44 left primer
aaatgtatcctcccaaagcaggg

SEQ ID NO: 142 - DNA, 23 bp, Artificial Sequence
  Locus number 45 left primer
ctgcatttaaggtgagctgtccc

SEQ ID NO: 143 - DNA, 23 bp, Artificial Sequence
  Locus number 46 left primer
ttctctgaggcggtattcctgac

SEQ ID NO: 144 - DNA, 19 bp, Artificial Sequence
  Locus number 47 left primer
gaagccggttcacacccac

SEQ ID NO: 145 - DNA, 23 bp, Artificial Sequence
  Locus number 48 left primer
cagtgagtgctgacaaccacacc

SEQ ID NO: 146 - DNA, 23 bp, Artificial Sequence
  Locus number 49 left primer
agatcgccgagctgtcgtagtag

SEQ ID NO: 147 - DNA, 23 bp, Artificial Sequence
  Locus number 50 left primer
cctcttcaggaagaagccgtagg

SEQ ID NO: 148 - DNA, 23 bp, Artificial Sequence
  Locus number 51 left primer
aaactttggagatgacggctgag

SEQ ID NO: 149 - DNA, 24 bp, Artificial Sequence
  Locus number 52 left primer
cgtcttaatgcaacaaacgaaacc

SEQ ID NO: 150 - DNA, 22 bp, Artificial Sequence
  Locus number 53 left primer
gctggtattggctgtgtgtgag

SEQ ID NO: 151 - DNA, 23 bp, Artificial Sequence
  Locus number 54 left primer
gtctcagtggttgctcacaatgc

SEQ ID NO: 152 - DNA, 23 bp, Artificial Sequence
  Locus number 55 left primer
atgatcgcttgagcccagataac

SEQ ID NO: 153 - DNA, 23 bp, Artificial Sequence
  Locus number 56 left primer
gcctcttgagtcttcattgctcc

SEQ ID NO: 154 - DNA, 23 bp, Artificial Sequence
  Locus number 57 left primer
caatggagagacatcgtcactgg

SEQ ID NO: 155 - DNA, 23 bp, Artificial Sequence
  Locus number 58 left primer
gggcagaagtcattgtttccatc

SEQ ID NO: 156 - DNA, 23 bp, Artificial Sequence
  Locus number 59 left primer
ttagtcctcagagcaatcctggg

SEQ ID NO: 157 - DNA, 23 bp, Artificial Sequence
  Locus number 60 left primer
ctctctgaggcactcactcaggc

SEQ ID NO: 158 - DNA, 22 bp, Artificial Sequence
  Locus number 61 left primer
cctccaaacttgtgtccaaagc

SEQ ID NO: 159 - DNA, 23 bp, Artificial Sequence
  Locus number 62 left primer
cttgcagctaggtggtcataccc

SEQ ID NO: 160 - DNA, 23 bp, Artificial Sequence
  Locus number 63 left primer
taacaagctccaaggtgatgtgg

SEQ ID NO: 161 - DNA, 23 bp, Artificial Sequence
  Locus number 64 left primer
caatgaccagtgtgaggtcaagg

SEQ ID NO: 162 - DNA, 23 bp, Artificial Sequence
  Locus number 65 left primer
ccatagaggtttggcgttcattc

SEQ ID NO: 163 - DNA, 23 bp, Artificial Sequence
  Locus number 66 left primer
taagcagagggaagttgtgaccc

SEQ ID NO: 164 - DNA, 23 bp, Artificial Sequence
  Locus number 67 left primer
agaagtgaggtcggaacaccaac

SEQ ID NO: 165 - DNA, 23 bp, Artificial Sequence
  Locus number 68 left primer
ctccctccctctctcttctgtcc

SEQ ID NO: 166 - DNA, 23 bp, Artificial Sequence
  Locus number 69 left primer
agtgcaagttcaggtgtccacag

SEQ ID NO: 167 - DNA, 23 bp, Artificial Sequence
  Locus number 70 left primer
ctccatctacatgcattgccttg

SEQ ID NO: 168 - DNA, 26 bp, Artificial Sequence
  Locus number 71 left primer
ctggctgggggatctgtctctttcac

SEQ ID NO: 169 - DNA, 26 bp, Artificial Sequence
  Locus number 72 left primer
cccgtagcctagagggagggagagtc

SEQ ID NO: 170 - DNA, 23 bp, Artificial Sequence
  Locus number 73 left primer
accttcttgcttccttcgctacc

SEQ ID NO: 171 - DNA, 23 bp, Artificial Sequence
  Locus number 74 left primer
agtcttcgctcaacctgatttgg

SEQ ID NO: 172 - DNA, 23 bp, Artificial Sequence
  Locus number 75 left primer
catgtatccgaggaaagcctgag

SEQ ID NO: 173 - DNA, 23 bp, Artificial Sequence
  Locus number 76 left primer
agggagtaagagtggttgggtcc

SEQ ID NO: 174 - DNA, 23 bp, Artificial Sequence
  Locus number 77 left primer
ctagcaggtggtaaagccagagc

SEQ ID NO: 175 - DNA, 23 bp, Artificial Sequence
  Locus number 78 left primer
ggtgagaggaacctctgagaagc

SEQ ID NO: 176 - DNA, 23 bp, Artificial Sequence
  Locus number 79 left primer
atggcgtttctctgagtcaggtc

SEQ ID NO: 177 - DNA, 23 bp, Artificial Sequence
  Locus number 80 left primer
ctcacgttaatcaacccgagtcc

SEQ ID NO: 178 - DNA, 23 bp, Artificial Sequence
  Locus number 81 left primer
tttgtgaccggtgtgtcactagg

SEQ ID NO: 179 - DNA, 23 bp, Artificial Sequence
  Locus number 82 left primer
ccagagaaggtaagagcgcacac

SEQ ID NO: 180 - DNA, 23 bp, Artificial Sequence
  Locus number 83 left primer
tgagagcctagggaaaccatctg

SEQ ID NO: 181 - DNA, 23 bp, Artificial Sequence
  Locus number 84 left primer
cgttctcgatccagttccatctc

SEQ ID NO: 182 - DNA, 23 bp, Artificial Sequence
  Locus number 85 left primer
aagccagattagagaaggccacc

SEQ ID NO: 183 - DNA, 26 bp, Artificial Sequence
  Locus number 86 left primer
tgaggcaagggcaagatcctgttgat

SEQ ID NO: 184 - DNA, 23 bp, Artificial Sequence
  Locus number 87 left primer
agcaatttcgggtgtctttatgc

SEQ ID NO: 185 - DNA, 23 bp, Artificial Sequence
  Locus number 88 left primer
caatgccttactatggcctgagc

SEQ ID NO: 186 - DNA, 23 bp, Artificial Sequence
  Locus number 89 left primer
cattcaggtggtggcagtgtaag

SEQ ID NO: 187 - DNA, 23 bp, Artificial Sequence
  Locus number 90 left primer
tctaccaggaagaatcgctgctc

SEQ ID NO: 188 - DNA, 23 bp, Artificial Sequence
  Locus number 91 left primer
ttcatctgcagtcagacaggtcc

SEQ ID NO: 189 - DNA, 23 bp, Artificial Sequence
  Locus number 92 left primer
aatccagatgttaaagggaggcg

SEQ ID NO: 190 - DNA, 23 bp, Artificial Sequence
  Locus number 93 left primer
ggatatcgctcttgtcttgtggg

SEQ ID NO: 191 - DNA, 32 bp, Artificial Sequence
  Locus number 94 left primer
ctttatatccggcaatttagtggcaactcttc

SEQ ID NO: 192 - DNA, 23 bp, Artificial Sequence
  Locus number 95 left primer
cgagcagcaggtttctctctctc

SEQ ID NO: 193 - DNA, 23 bp, Artificial Sequence
  Locus number 96 left primer
cgtacctctcctgctagcctctg

SEQ ID NO: 194 - DNA, 23 bp, Artificial Sequence
  Locus number 97 left primer
aattcacaaacgttgccttggag

SEQ ID NO: 195 - DNA, 23 bp, Artificial Sequence
  Locus number 1 right primer
gctcctcagcttcagacaaggtc

SEQ ID NO: 196 - DNA, 23 bp, Artificial Sequence
  Locus number 2 right primer
gctcaacagctgcaagaagagtg

SEQ ID NO: 197 - DNA, 23 bp, Artificial Sequence
  Locus number 3 right primer
atcagtgtgggctgtgagttcag

SEQ ID NO: 198 - DNA, 23 bp, Artificial Sequence
  Locus number 4 right primer
atgagacgtgcacaacctactgg

SEQ ID NO: 199 - DNA, 23 bp, Artificial Sequence
  Locus number 5 right primer
actagtgggaggtgtcctttccc

SEQ ID NO: 200 - DNA, 23 bp, Artificial Sequence
  Locus number 6 right primer
ttgagtcttctcaccttccagcc

SEQ ID NO: 201 - DNA, 23 bp, Artificial Sequence
  Locus number 7 right primer
attagtggcccaaacacataccc

SEQ ID NO: 202 - DNA, 23 bp, Artificial Sequence
  Locus number 8 right primer
cacacatgctgaacacagactcg

SEQ ID NO: 203 - DNA, 23 bp, Artificial Sequence
  Locus number 9 right primer
gaaactcgagtatgcagtcggtg

SEQ ID NO: 204 - DNA, 23 bp, Artificial Sequence
  Locus number 10 right primer
gtgattgaaaggaggtctgggtc

SEQ ID NO: 205 - DNA, 23 bp, Artificial Sequence
  Locus number 11 right primer
ggaggaaggcatggacaatgtag

SEQ ID NO: 206 - DNA, 23 bp, Artificial Sequence
  Locus number 12 right primer
acggatctgagcagaagaaatgc

SEQ ID NO: 207 - DNA, 23 bp, Artificial Sequence
  Locus number 13 right primer
tcagagatggagcggaataggtc

SEQ ID NO: 208 - DNA, 23 bp, Artificial Sequence
  Locus number 14 right primer
tcatctgtgttgttccagtgcag

SEQ ID NO: 209 - DNA, 23 bp, Artificial Sequence
  Locus number 15 right primer
tcatctgtgttgttccagtgcag

SEQ ID NO: 210 - DNA, 23 bp, Artificial Sequence
  Locus number 16 right primer
acctctggctgaccttgagattg

SEQ ID NO: 211 - DNA, 23 bp, Artificial Sequence
  Locus number 17 right primer
ttcagggaatgagaaatgatcgg

SEQ ID NO: 212 - DNA, 23 bp, Artificial Sequence
  Locus number 18 right primer
agctcggtagacttctggtagcg

SEQ ID NO: 213 - DNA, 22 bp, Artificial Sequence
  Locus number 19 right primer
ctagccggaaaggtgggataag

SEQ ID NO: 214 - DNA, 23 bp, Artificial Sequence
  Locus number 20 right primer
cgtgtgatccacttacttgtccg

SEQ ID NO: 215 - DNA, 23 bp, Artificial Sequence
  Locus number 21 right primer
cgtgtgatccacttacttgtccg

SEQ ID NO: 216 - DNA, 23 bp, Artificial Sequence
  Locus number 22 right primer
agccagcagttcctagagcagtc

SEQ ID NO: 217 - DNA, 23 bp, Artificial Sequence
  Locus number 23 right primer
gcccatacgcaacgagattagag

SEQ ID NO: 218 - DNA, 23 bp, Artificial Sequence
  Locus number 24 right primer
tatggcaggttggagaaagatgg

SEQ ID NO: 219 - DNA, 23 bp, Artificial Sequence
  Locus number 25 right primer
acgtgcatacagttctccgtgtc

SEQ ID NO: 220 - DNA, 19 bp, Artificial Sequence
  Locus number 26 right primer
gggcccaacagggagggtc

SEQ ID NO: 221 - DNA, 23 bp, Artificial Sequence
  Locus number 27 right primer
attgcctaggagtcggttgactg

SEQ ID NO: 222 - DNA, 23 bp, Artificial Sequence
  Locus number 28 right primer
gcctcaacagtggacacatcaag

SEQ ID NO: 223 - DNA, 23 bp, Artificial Sequence
  Locus number 29 right primer
aagaagatgaagatgcggcagag

SEQ ID NO: 224 - DNA, 23 bp, Artificial Sequence
  Locus number 30 right primer
taccggagatgtcctccagaaag

SEQ ID NO: 225 - DNA, 23 bp, Artificial Sequence
  Locus number 31 right primer
aaatctgcaatctgacctccgtg

SEQ ID NO: 226 - DNA, 19 bp, Artificial Sequence
  Locus number 32 right primer
ccaactccgttcccaaccc

SEQ ID NO: 227 - DNA, 23 bp, Artificial Sequence
  Locus number 33 right primer
gttccttgccatgtggatttctc

SEQ ID NO: 228 - DNA, 23 bp, Artificial Sequence
  Locus number 34 right primer
tcacaaagctggaaactcttccc

SEQ ID NO: 229 - DNA, 23 bp, Artificial Sequence
  Locus number 35 right primer
gatgtcaggaggctcagatccag

SEQ ID NO: 230 - DNA, 23 bp, Artificial Sequence
  Locus number 36 right primer
cccaactccctagtttcccagag

SEQ ID NO: 231 - DNA, 23 bp, Artificial Sequence
  Locus number 37 right primer
ttggctagaagaaatgaggtggg

SEQ ID NO: 232 - DNA, 23 bp, Artificial Sequence
  Locus number 38 right primer
ttggctagaagaaatgaggtggg

SEQ ID NO: 233 - DNA, 23 bp, Artificial Sequence
  Locus number 39 right primer
gcccatacgcaacgagattagag

SEQ ID NO: 234 - DNA, 23 bp, Artificial Sequence
  Locus number 40 right primer
tgcaagctacgggagaaagaaac

SEQ ID NO: 235 - DNA, 23 bp, Artificial Sequence
  Locus number 41 right primer
ccagtgacgatgtctctccattg

SEQ ID NO: 236 - DNA, 23 bp, Artificial Sequence
  Locus number 42 right primer
aaatgagccacttctgaacgagc

SEQ ID NO: 237 - DNA, 23 bp, Artificial Sequence
  Locus number 43 right primer
gaagttcggcttcacactcttcc

SEQ ID NO: 238 - DNA, 23 bp, Artificial Sequence
  Locus number 44 right primer
ctttccctcctccttcagtctcc

SEQ ID NO: 239 - DNA, 23 bp, Artificial Sequence
  Locus number 45 right primer
atttgagaacccaagttgcttgc

SEQ ID NO: 240 - DNA, 22 bp, Artificial Sequence
  Locus number 46 right primer
gtgagaggcccagagagggtag

SEQ ID NO: 241 - DNA, 24 bp, Artificial Sequence
  Locus number 47 right primer
tctagaaggcctgctgtcaggtag

SEQ ID NO: 242 - DNA, 23 bp, Artificial Sequence
  Locus number 48 right primer
ttcctcgacttggcaaaggtaac

SEQ ID NO: 243 - DNA, 23 bp, Artificial Sequence
  Locus number 49 right primer
aggccaaggagcagaaactaagc

SEQ ID NO: 244 - DNA, 23 bp, Artificial Sequence
  Locus number 50 right primer
ctaacacactcagccattggtgc

SEQ ID NO: 245 - DNA, 23 bp, Artificial Sequence
  Locus number 51 right primer
tttcagctcctgccatttaccac

SEQ ID NO: 246 - DNA, 23 bp, Artificial Sequence
  Locus number 52 right primer
atggctgggaactagcacaagag

SEQ ID NO: 247 - DNA, 23 bp, Artificial Sequence
  Locus number 53 right primer
gtggtttctagtctgggtgcctc

SEQ ID NO: 248 - DNA, 23 bp, Artificial Sequence
  Locus number 54 right primer
tgcaagctacgggagaaagaaac

SEQ ID NO: 249 - DNA, 23 bp, Artificial Sequence
  Locus number 55 right primer
gagacttcggctccagttacagc

SEQ ID NO: 250 - DNA, 19 bp, Artificial Sequence
  Locus number 56 right primer
gggagggcttcctggacac

SEQ ID NO: 251 - DNA, 23 bp, Artificial Sequence
  Locus number 57 right primer
ccatcctcctcctggatcctaac

SEQ ID NO: 252 - DNA, 23 bp, Artificial Sequence
  Locus number 58 right primer
aaatctgtgccagaaggagttgc

SEQ ID NO: 253 - DNA, 19 bp, Artificial Sequence
  Locus number 59 right primer
gggttccgggttgaggagg

SEQ ID NO: 254 - DNA, 23 bp, Artificial Sequence
  Locus number 60 right primer
ctccttgcctctggagactcttg

SEQ ID NO: 255 - DNA, 23 bp, Artificial Sequence
  Locus number 61 right primer
tctcagacatcctgatgccactc

SEQ ID NO: 256 - DNA, 23 bp, Artificial Sequence
  Locus number 62 right primer
cccgtgggtctctgtatttatgc

SEQ ID NO: 257 - DNA, 23 bp, Artificial Sequence
  Locus number 63 right primer
tcagccatgtcaagtgaggagac

SEQ ID NO: 258 - DNA, 23 bp, Artificial Sequence
  Locus number 64 right primer
tgtggtgtgaatgtgggaagaac

SEQ ID NO: 259 - DNA, 24 bp, Artificial Sequence
  Locus number 65 right primer
tgcattatttaagcatgtccaggg

SEQ ID NO: 260 - DNA, 23 bp, Artificial Sequence
  Locus number 66 right primer
gactatccctcctctctgccctc

SEQ ID NO: 261 - DNA, 22 bp, Artificial Sequence
  Locus number 67 right primer
cagagacaaggagggcttggag

SEQ ID NO: 262 - DNA, 23 bp, Artificial Sequence
  Locus number 68 right primer
agcaagcatcttctctttccctg

SEQ ID NO: 263 - DNA, 23 bp, Artificial Sequence
  Locus number 69 right primer
tatgcctgggagagagtgagacc

SEQ ID NO: 264 - DNA, 23 bp, Artificial Sequence
  Locus number 70 right primer
gggagacagggactttccttcag

SEQ ID NO: 265 - DNA, 20 bp, Artificial Sequence
  Locus number 71 right primer
atgggggcacggaggcatca

SEQ ID NO: 266 - DNA, 25 bp, Artificial Sequence
  Locus number 72 right primer
gcctggcccatttgcatttttacag

SEQ ID NO: 267 - DNA, 23 bp, Artificial Sequence
  Locus number 73 right primer
agtcagaccagtaccgaggttcg

SEQ ID NO: 268 - DNA, 23 bp, Artificial Sequence
  Locus number 74 right primer
gaacttagcctgctcttcgggtc

SEQ ID NO: 269 - DNA, 19 bp, Artificial Sequence
  Locus number 75 right primer
gagttggcgcagcacggac

SEQ ID NO: 270 - DNA, 23 bp, Artificial Sequence
  Locus number 76 right primer
ttcacctgctcagtcacacacac

SEQ ID NO: 271 - DNA, 23 bp, Artificial Sequence
  Locus number 77 right primer
atgctcacacacacaatggacac

SEQ ID NO: 272 - DNA, 23 bp, Artificial Sequence
  Locus number 78 right primer
ttgcgtgcctactaagtgcagac

SEQ ID NO: 273 - DNA, 23 bp, Artificial Sequence
  Locus number 79 right primer
cgatgatcctagtcgggttcctg

SEQ ID NO: 274 - DNA, 23 bp, Artificial Sequence
  Locus number 80 right primer
atcctgcaatgtttggatgatgg

SEQ ID NO: 275 - DNA, 23 bp, Artificial Sequence
  Locus number 81 right primer
gactgactaacacaggaaggccc

SEQ ID NO: 276 - DNA, 23 bp, Artificial Sequence
  Locus number 82 right primer
aatcctgacaactcgggaaggag

SEQ ID NO: 277 - DNA, 23 bp, Artificial Sequence
  Locus number 83 right primer
cacctttcattctgagccagagc

SEQ ID NO: 278 - DNA, 23 bp, Artificial Sequence
  Locus number 84 right primer
accgagtgatacaaaggactggg

SEQ ID NO: 279 - DNA, 25 bp, Artificial Sequence
  Locus number 85 right primer
tgacaatgttgtccagtaaagcctc

SEQ ID NO: 280 - DNA, 31 bp, Artificial Sequence
  Locus number 86 right primer
tcccggaaaacccaagtatttgttcagttac

SEQ ID NO: 281 - DNA, 24 bp, Artificial Sequence
  Locus number 87 right primer
tgttaattctctgatggctgggtc

SEQ ID NO: 282 - DNA, 23 bp, Artificial Sequence
  Locus number 88 right primer
tatttgcaagagtggacccaagg

SEQ ID NO: 283 - DNA, 23 bp, Artificial Sequence
  Locus number 89 right primer
agtgggacttgctgtctgaatcc

SEQ ID NO: 284 - DNA, 23 bp, Artificial Sequence
  Locus number 90 right primer
acccttagtcccagatcctttgc

SEQ ID NO: 285 - DNA, 19 bp, Artificial Sequence
  Locus number 91 right primer
gaaggacatgcgaccaggg

SEQ ID NO: 286 - DNA, 23 bp, Artificial Sequence
  Locus number 92 right primer
tccgagatttaactgaaggcagc

SEQ ID NO: 287 - DNA, 23 bp, Artificial Sequence
  Locus number 93 right primer
tcagcatgttaatcgaagccttg

SEQ ID NO: 288 - DNA, 22 bp, Artificial Sequence
  Locus number 94 right primer
cgaggcaggagggaggcaccta

SEQ ID NO: 289 - DNA, 23 bp, Artificial Sequence
  Locus number 95 right primer
agaccacatccttgctcagttcc

SEQ ID NO: 290 - DNA, 23 bp, Artificial Sequence
  Locus number 96 right primer
taccattgctgtgggcatacaag

SEQ ID NO: 291 - DNA, 23 bp, Artificial Sequence
  Locus number 97 right primer
ctgtgggtccatttctctcttgc

SEQ ID NO: 292 - DNA, 465 bp, Artificial Sequence
  Locus number 1 amplicon
tagcgtcgggtattgaaggagagtgagtctgtggacagggtgcgacgtacactggctcgatttaggaatctgatttcggtggtgtgtgagcagggtgcattcggtagaaactactttgagttttgaccgttccccagctggccgtatgaggtcagtactctcctgtgatgaggggcggtgactgcagccccagcgggccacgtgatcaggagggggccgaatgtcccgaggggctctgcgtgcagggggttttgccggactgtaggctggcgtgtgtctgtcaggttaaggcaggtaaggctgcgccgcttggtcgtgggttctgtgtggaagtgcagtctccacccaggatgtttccagcgccgctcggtcgtgggttctgtgtgggaagcgcagtctccacctaggatgtttccagcacatggagggtttattgggaggtgaccttgtctgaagctgaggagc

SEQ ID NO: 293 - DNA, 473 bp, Artificial Sequence
  Locus number 2 amplicon
tggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagc

SEQ ID NO: 294 - DNA, 427 bp, Artificial Sequence
  Locus number 3 amplicon
ccaccagtcagaaccagtcattgctaggcgggcagctccccgtgggcaacggctggctgaaggatctgtaccctggcgctgcagggagctgggcgttcagcccctcagtgtggtgcttgtgaaattaacgaggggagcgtgagagtgaatatacaggtgggagcgggagagacgtcctgggaaggagaggtcagctgctcattcattcctcagcctgctgtgggcctcatcctagtactaggtccgcaaaacatgagaatgtgttacactggaatgaactgaattcaatttgacgtttctaaggttgtattcctattcctttcctccctgccctgtgaattcttcccaagaagacacacacacactaaccttccaagggtgcatatacactccccaacaggcctctgaactcacagcccacactgat

SEQ ID NO: 295 - DNA, 406 bp, Artificial Sequence
  Locus number 4 amplicon
gtctcgcttcttccgtctctgtcctacagcttggcggtaactgacgacctgtgagcttttagctgcaaactgcaactacgcggcaaacaatttatttagcccgacatctagccggtctccggcaggaccctgcaccgcgtcgggatcggacccttccgctggggcggcctcctgcgtcaaggccagcaggaaccttcctgtcgccctccccggccgccgcttcgcctccttcccgcccccggaggttgtgcaggcgctatggtccgcctggagggagaaagccggcggccggttcctgagccgagagcggccgcggaaaaatcctctgcctccgctggaaatcgatattaggccggcgcgggcgcgggacgtcggggccgcagccagtaggttgtgcacgtctcat

SEQ ID NO: 296 - DNA, 524 bp, Artificial Sequence
  Locus number 5 amplicon
cttagtaagttgcgtggatgggccacactgtctgaggccagataaggctgttctcttcccctgaccccccacccctcaccccgtggacacttggaggaggggaaactcagtaagtcatgctctcttctttgaattcctagctcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtggtacgtaagcgggtatctacctctcctgaaagccttttctcttccttccttgtccgtttctctttcctggcagtactggcagtgtaatcataaaaagaggcaggctggggattccttacccgggggatgtattccaaagaaataactgtagttcaaatatttaaaatgttttgggaaaggacacctcccactagt

SEQ ID NO: 297 - DNA, 550 bp, Artificial Sequence
  Locus number 6 amplicon
cataccttgctgtgtgttctgccgttctttctccagatcgcctgaaagctcctcttgaatgtgggggtctcccctcccggctccaggtttttaaacaacagcctcacctctggagactccctggctgggtgtagccccaccgcagggcgggtctcaggaatctggcagccgtcacacccatctgtcgtcactgcacccccacctcccaggacgggactgggcaagtgggttggtcggtccgtcccagagttcttgtagtgagctccacaatgcccacctgcctgtgggggctgcaaggggcccctcaaacagaaagcacaaggcacatgtaagtgatcatcagagaccagaattcacagggtggggaagggcccttgcatttgtgccaggcaatgaactcagcattttcccaaagccagcaggggtcagcttcttcttgtgacctggaccaccccagacagaagatcaggcagagaacacaaagattagggcttatatagagagttaaagctccagacatatcaccgggctggaaggtgagaagactcaa

SEQ ID NO: 298 - DNA, 558 bp, Artificial Sequence
  Locus number 7 amplicon
tttgaactgaccaactgggagacgtccccgagcttgaataagggcctcaaaagcttagcgttttatgcagagtcgcaaccacccagcgctgggaacctgagcctgcacaacccactagaaagcacccgtgaccgtcccctgcgcccgttatccctgcgccccgcacccctgtatccccggcttctctgcagctgtacaccctgcactgcggcgccccccagtcccgctgtccgctccatcgcgcaggtctccaaaacgaatcccggcttggaggggctcagcggccctgggcctgtgcgccgttgcggccgggagggtcattttcatgcctaaggacccgccccttgcacgcaacctcgggtagccagccggaaacggcgtcccgggctccaaaggacatctctttttacatttcagcaaaacagccgcacaccttctccccagatggcctctgtgcagcctgaaaatgcccgctccctccaagtccctgggcaattgctgggacgcatctcagagactgcgcggggcggagaaggggtatgtgtttgggccactaat

SEQ ID NO: 299 - DNA, 450 bp, Artificial Sequence
  Locus number 8 amplicon
ccagtgggtgaggagagtcaaacagagtgaaaagaaatgagtccagaatgttaaacatgatttcctttggtgccgttttccattagctcctcctcccgcagggcgtggagagcagccggttactcgagggtagggcgtctagagcagccggttacgcgagggtagggcgtggagagcagccggttacgcgagggtagggcgtggagagcagccggttacgcgagggtagggcgtggagagcagccggttacgcgagggtagggcgtggagagcagccggttacgcggttacacgagggcggagggcgtgtgccgggagcacaatccgggccgaggctcctggtaagggagcagagcgggaagctgatcccccacggattcttagggggccgacttcccctgtgttgaagattcatcaaagactgattcgagtctgtgttcagcatgtgtg

SEQ ID NO: 300 - DNA, 472 bp, Artificial Sequence
  Locus number 9 amplicon
atgcaacttcagggaagagatgcattatccccagaccctcgctgctgcagtttcccacccactccatatcatttccagggtcaggccagccgagagttaatagaaaatcactggcctcctctctaaggctgctgaccttggcctttgtggagccctggggcctatagaagagaagtgccaacccccacaagcaaagttcagattccaagaggagggtgccctcgagtcccacagacccccaacccaggagaaaagcagtgagcagtcttttcttgtgcccctcagatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttc

SEQ ID NO: 301 - DNA, 536 bp, Artificial Sequence
  Locus number 10 amplicon
ttacgcaccttcacaaacctcagaaataactcattggagagccccagatgtcagccgttaccccccgcccggtcttccccaacacaggggaccacagtctgggagccaggagggcaaggcccgcccgctcaccttgggcttgctgccgccgatggcaccaggacgtatggagccagtctcctggtacctgcacaggatcttggagacgcagccgtgggacacgcgcagctggcgcgagatgacgcagggccggatgccgtggtgggccatctccacgatcttgtggcggatgtggttgggcagcggcctgccgttgataaaaacaccgccgagctggttgacgcggccctggccgaggggagtggacactgtgggaaggtgaaaaagagaagcaagggaaaagtcactggaggaaaataaaaagcaaagaacagcagcacgtaatttcgcagtcttctgtcctatcctcatgttacagcaccgacgctgaaactgctcgacatcggactcccagacccagacctcctttcaatcac

SEQ ID NO: 302 - DNA, 473 bp, Artificial Sequence
  Locus number 11 amplicon
cacaacagatgagatggccaaaggattgctgagtgcgcacacgcaagtgtagaacagtgcgaagctttccaacccagttttccaaccacagcagcaccaacatcggcatgtctggggtctccgagaacgaggtccttaatgcacttagactctccagggcatttatcacggttttttttttcttttttgatgtgtgtgttcgcgcgctcgcgcgctcgcgtgtgtgtggtggtgaaacccaggagtgcgcgaagattttcagggtcaaggcacagccacaggggagggggcaagttgagactagtgggctggggcggtggccttgtaggtcctgggacagagtggccaggagcagatcgccagaaagctggtactgagcgcgttctgccctgcgcttcctgcgttttgtgtcatcagtatagttagtgtttggcacggctgttttgatcactacattgtccatgccttcctcc

SEQ ID NO: 303 - DNA, 416 bp, Artificial Sequence
  Locus number 12 amplicon
tagtcctggtgctctcctttcccggggtcctggtccccggtctctgggctcggactgactgcccactgaccagagcccgggccagtccactcactggtctaacaaataaagagcccttcccgcgcttcccggtgccaggcccacgctgggggaggccgaggggcctgcagggcagccgacgtccgctaaccaggtgactgggccgtgcgctgcagggttgtgggccacggtcactgcgcccgcttggttcggacctcggcaactggccgcactgacccgtcaactcccggtttcccggcgcacgcccctcgtgagatgctgtggtcttttctagcaacgtcgacaggctttccaacaaaattcctctttcctgcgcagaaccgctctccactcgcatttcttctgctcagatccgt

SEQ ID NO: 304 - DNA, 404 bp, Artificial Sequence
  Locus number 13 amplicon
accatctagcacctccctccttcctggctgaattccctgtcattttaagtaggcagcaattactggtttgctaaagaagccagctcctgctgccaaggatcctgttaattatcactctatctctaatttagccttcctagtgttgagagaaggtgcacgtaagcgtgtggcagaacgtctgcaatcgcatctttgtaataatctcctttctgagacggttcagtggactcaatgttccgccaaagggccaaggcagccctggtgagtgttttcagctctcttctgtagcttgtttggtcagtcgagtttggtgtgattgtcctctccttttgcttctgacctaagtaaaagctaatggttggcattaatcttgggaattcagacctattccgctccatctctga

SEQ ID NO: 305 - DNA, 556 bp, Artificial Sequence
  Locus number 14 amplicon
ttaacctgctcctgttggacctctgccactttactgaccccataaaacaaacagagctagcaaatgcatcaaacagcctccttcaaaatgcagcttgactgtgattcatggcacaaagctggaataaccctgccagttcttagaagctttaagattcatcgtcttgaacttgatacacatagtatagcaccttaaaaacgaatcatctgctagttcagtattttctacttacaatcactccctcccagggcatgtaattaatttactgagcttaaaaaaaaaatatcaggattactcacacagtcttgaagatgcaatgtcagctatttaggacagaaacatccaaggccgtgtcagaactcaattacgactacatatgcattaaggcaggaactggcaggcctcagggtacgccaactataggactcgtgcttctcgtacgctgggctataatctatgaaactgagctccagagccagccaatcacttagctcctcataacaagtctaactggctctggaaagctgaaagggctgcactggaacaacacagatga

SEQ ID NO: 306 - DNA, 556 bp, Artificial Sequence; identical to SEQ ID NO: 305
  Locus number 15 amplicon

SEQ ID NO: 307 - DNA, 565 bp, Artificial Sequence
  Locus number 16 amplicon
cttcaatccacctctgtgtgtgctggagcacggcttcaatgctgcacctctgtgtgtgccgctctgtgtgtgccggagcacggcttcaatgctgcacctctgtgtgcgccggagcacggcttcaatccacctgtgtgtgcgccggagcacagcttcaatgctgcacctctgtgtgtgctggagcacagcttcaatccacctctgtgtgcgccggagcacagcgtcaatccacctctgtgtgcgccggagcacggcttcaatccacctctgtgtgcgccggagcacggcttcaatccacctctgtgtgcgccggagcacggcttcaatccacctgtgtgtgcgccggagcacggcttcaatccacctgtgtgtgcgccggagcacggcttcaatccacctgtgtgtgcgccggagcacggcttcaatccacctctgtgtgtgccggagcacggcttcaatgctgcacctctgtgtgtgctggagcacggcttcgatgctccaccacattacaactctgcctttgtcttcatttcctgcttgaacaatctcaaggtcagccagaggt

SEQ ID NO: 308 - DNA, 495 bp, Artificial Sequence
  Locus number 17 amplicon
aatgctgtggctcctaaggactgccagcaggttgtggggctagccagaaaaaacagagcctctgattctagaaggcttggagaaagcgtgagaagggagatcagatcagaatagattgatggaagggaaaggcggtgagggtgaagcaagagaaactcggctccagtgaaaaggacccatcattgcattccagaacgtaatttgcatttcatatgtaaatgaggaggcttcctagaggctggactgggctgggcttagctgagcctttgcaaacagcagggattcaaccctggggaactgcagaccaaagtgagagagggacgcaccgcatctccaggcacatccaaaaaggatggacgagacaccgaagcagaggatacaggaggattaaaggattcaggaaagcaagcagccctccggagaagctgtcgaaattcaagactggcaagagaagcaaattcaacctctcacaccgatcatttctcattccctgaa

SEQ ID NO: 309 - DNA, 443 bp, Artificial Sequence
  Locus number 18 amplicon
ctttgcaggtcatggtctacgtgaaacatcaaagaaacctgtaacggaaaacgacttgtttgaaagagccagttctctatccaaatttaccaatcagaatcttgcactgaaaaaataaaccaatcgtgaatctctacggccacttccggaatttagcaaccgatcactaacagggatcgtccacaatccaatcagagtgattctgttcctatatagaggggcaaaccaatcttcctaactcatttactttgcagatgaactatggcgcgtactaagcagacggctcgtaaatccacaggcggtaaagcaccgcgcaaacagctggccactaaggcagctcgcaagagcgctccggccacgggcggcgtgaagaagccccatcgctaccgccctggcaccgtggctctgcgcgagatccgtcgctaccagaagtctaccgagct

SEQ ID NO: 310 - DNA, 552 bp, Artificial Sequence
  Locus number 19 amplicon
cgcatttgattctggttgacttgggatacctgagctcggctctcattagctcttccgctcgacccacaatccctagtgtttgcaggtgttgcattcccccaacccctttcttctcttcaaccagtagcctccaccttcccatccctgctttggagaaggaggaaaacgcagcttgagatctactcgaagaactgaccctcagctctcacaggctgccgccgagctgcaagcatgccgccgctccactcgggtaaacttcggagtgagttacctgcactcggagaagggccttacctgagcgcgcctctgccaatggcagctcacctgagggagctccccagccaatcatcgcgcagctcgtccctcgggcttgtaccctttagtgaaagaattcagctccttgcgagaaagttacctgtggccgcccaagtccgccactttctgctctgtgtctgcccattgccacgatccaggaggactccgcgccgcccggccgcctccgagctcgggccccatgtgaggggcccccccttatcccacctttccggctag

SEQ ID NO: 311 - DNA, 582 bp, Artificial Sequence
  Locus number 20 amplicon
aactgaccctcagctctcacaggctgccgccgagctgcaagcatgccgccgctccactcgggtaaacttcggagtgagttacctgcactcggagaagggccttacctgagcgcgcctctgccaatggcagctcacctgagggagctccccagccaatcatcgcgcagctcgtccctcgggcttgtaccctttagtgaaagaattcagctccttgcgagaaagttacctgtggccgcccaagtccgccactttctgctctgtgtctgcccattgccacgatccaggaggactccgcgccgcccggccgcctccgagctcgggccccatgtgaggggcccccccttatcccacctttccggctaggtgagggcgcgagcgggcgagcgagcgagagtggtgaggggggacggaaaagcagaattacctgtagctcttgttctgccatctcgggcgctctcacacaccttcacctgcacagacttgaaagtccagtttcaccagaggctgaggctccaggaaaagcggagcaagttcattggatcaaacatgtcacaagagtcggacaagtaagtggatcacacg

SEQ ID NO: 312 - DNA, 527 bp, Artificial Sequence
  Locus number 21 amplicon
actcgggtaaacttcggagtgagttacctgcactcggagaagggccttacctgagcgcgcctctgccaatggcagctcacctgagggagctccccagccaatcatcgcgcagctcgtccctcgggcttgtaccctttagtgaaagaattcagctccttgcgagaaagttacctgtggccgcccaagtccgccactttctgctctgtgtctgcccattgccacgatccaggaggactccgcgccgcccggccgcctccgagctcgggccccatgtgaggggcccccccttatcccacctttccggctaggtgagggcgcgagcgggcgagcgagcgagagtggtgaggggggacggaaaagcagaattacctgtagctcttgttctgccatctcgggcgctctcacacaccttcacctgcacagacttgaaagtccagtttcaccagaggctgaggctccaggaaaagcggagcaagttcattggatcaaacatgtcacaagagtcggacaagtaagtggatcacacg

SEQ ID NO: 313 - DNA, 444 bp, Artificial Sequence
  Locus number 22 amplicon
attgtcgaacatgtcctgggaggcggggtccaggctccagtagttgcccttgcctgggcggcccggctcgcgggggatcttgacgaagcagtcgttcagcgagaggttgtggcggatgctgttctgccaggcggggaacttgcggcggtagtaggggaagcggtcactaatgaaggcgcagatgccgctgagcgtgaggcgcttgtgcgggctttgcaggatggccatggtgatgagcgcgatgtacgaggaggggggctttgccggctgccgggcatcttcagaggccgccgcagaccttggcggtgccctgaactcggtgccaaactctgaggggtcgctcgggccgccgccgccctcgatgtgctctcggggaagcgcaaccccgccccaccgggccacctgcagccccggctggagcgactgctctaggaactgctggct

SEQ ID NO: 314 - DNA, 499 bp, Artificial Sequence
  Locus number 23 amplicon
ggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacgcatgcctgcttctacaaacccacaaatggtttccgatcatttctgaaacaaaatggatgctcatttattcatgtgctctggcttctgccttcctctctaatctcgttgcgtatgggc

SEQ ID NO: 315 - DNA, 427 bp, Artificial Sequence
  Locus number 24 amplicon
ctcacactgacactgaactccgctagcccactctctgttttataatactggactcaagagatctcatcaagagaaacctaaatcacaactagggatagtaggtggcaatcttaagtgtgaacacttcctgtggccatatggagggactcaaggccaggaacacgaacacgaagagatcactgggcgttttgaggaaaggaacgtcagagtgggtctctgacacggagtgagctgagtgttgcagcctgtctagtcagcagtaactgcttcccacaccacgtgacacagtccttatgctggaattggcagcttagtcccaaggtcatgaatcagttctttgttcctacctttcttctgctgcttcagctgcttctgctttttcttcttcaagttttttcaggaggccatctttctccaacctgccata

SEQ ID NO: 316 - DNA, 458 bp, Artificial Sequence
  Locus number 25 amplicon
taaagaaagtgaagcagaggcggctcgccttgatccactgcaaacaaatttggcgcactttcgagtccttcctccgcctcaaaaaggcaggacagtcagcttattagccgctcgtttgctttattaattcatctatttaaagtggcaggattagagtgtctaatgtggacgcgggctgccgtggcgctgaggaatataaatatttgcgagatgccatcccacgatgactatctgggagtggggcgcggggcagggtgcgcgtgtgccctgcctctgcgttcccttcgcagtgcgcgcgtgctgagctgagcagggggttgtaggagccatgagccgcaggtctatgtgccccttcgtgctatatgggtgccagccctggatgctcccgggcagggctcaatgggcatcgtgggtcagattctgcgctccttctgggacacggagaactgtatgcacgt

SEQ ID NO: 317 - DNA, 429 bp, Artificial Sequence
  Locus number 26 amplicon
acctgcactaccttcaacttggccagcctctcctttaatctgctcatcttgcagtgagtatagagctgtgttactctgattcaaagaaacactctaaaatatagcatgtgatggacattgtgattagttcccagcacccatttcacccttgccaatgattcacctatccagaaaaatgttcatgtgacacaattctgatcatggaggaaagtcacttgggtggggattagtctgatgaaagtctccccactcccaagaaagatgaagaaagaccactctaccccttcctatggacgttgacctctctgaacgtaattccataagagctgtagccatcttgccacacaagttgaagaagcaacctctcagagatggtgactaaaaatatagaaaaaatcaacgtctttaatgaccctccctgttgggccc

SEQ ID NO: 318 - DNA, 598 bp, Artificial Sequence
  Locus number 27 amplicon
gtggctgtgtacaggtggatcaggccaccccagctggagccgagcagtggggaggcattgggataggctctgaggacgctcatgctgcagacgctgcacaaggcacagacccagagcctgaggcgggcccccaacatcgtgccctgctctgagtggctggtgctgagattgaaacctgacactcctgtcgggactctcctggcccaggccttactggccttttccttctcccttgcaagtagctggtgtgaggatcctagactggattccctcctttttgccgtcagacttttaaagggtagcagtgtgacatcaaacaggaaaaactccactgtccacatcctctgtgttgtaatcagcccattgaaagaaagtgcaaagaccccggaggcgcacggaaggcacgtcggttccagacacacacacccctcaatttcaagccaacgctccaaaaaatgaatgacgtgtgggcaaaagttatctgccactctgggctgtctgttgacctgtcccacttccatcaggaaatgtgaaggcagccagcggttcccaaaaaaaatccagcttcagtcaagcagtcaaccgactcctaggcaat

SEQ ID NO: 319 - DNA, 454 bp, Artificial Sequence
  Locus number 28 amplicon
aatacaagtgaatcacccggcagttctgaggcgtgcggaacaaatccaggctcgcagaaccgtgaaaaaggagtggcaggtaagggttcttcttgagcattctgtgcctgtattttacaatgcatggtctcttccctcaaggccacaatattgaatttcactcaagatgcatctaaacttaaaagattgcagctgtccatgacttattttaataattcatatatgatgatgatgggttggagaaagataacacatttatccaaacaagttaaaatcttatcactcttgagtggcaaaaccgcaaatgaatttgaggcatctttattcatgagtgaattaaatggcatattttctcaacacatttattcagttttttagacatgccttctttggttgtcttctgttttaattttaaagccctaacatctaaacttgatgtgtccactgttgaggc

SEQ ID NO: 320 - DNA, 408 bp, Artificial Sequence
  Locus number 29 amplicon
tgggcttctttacatcttccctggcatttccagccctctcgcatgtctgctgggcagcagccttcacccggggcgctcccagcgcctctgctgcggccagcacatccccctgcgaggcggggcccagcaccccctcataggcaaaggtcagcacggcctcccagccccctggggacacctcgaggctgaaggggggccgcggacctccgccgcccagcagcctgtctcggaagaggctgctgattgcggccaggatcacccgatgcaccccgtatacccgccccgcgactgacacctcttcgtccagcaacagtctctgctcccgcagccgctgggcctcggcgaaaaactggctcggatgctcctcgctgcgcagccactcgggctctgccgcatcttcatcttctt

SEQ ID NO: 321 - DNA, 600 bp, Artificial Sequence
  Locus number 30 amplicon
gcataaggtctatttgccgttcggcatctgtcacggcgcttttgcactgcggtcatcactaaattgattcatagagtgtagattaaattgcttctctgatttaaaacagtgtccaactttggagtatgcgtgtgagtatcttctcccgccccaaggtatttttgtcagggagaaaactgtcgccccactatccttacaccccattccgcataactgtaaaaaaataatgcatcttcgaccccaacttcttacggttcgtttcaggaactttcttaattctctccgtctcctgcccggccacagagcagagttcacaatcggatgcgtttaagtcggatttttcgtgtcatgtgcaaaaagccggtgtgtccttttcaaggtacggagccctcatcggagggcgcattagcggggtcagaggaattaggagcaatgcgcagagccccctgcagcccgcgtgctgcgccgagacctcagccgtcctcactgagcggaatggttgtgttgtttgtattgggacttttaaaaaatccagtctcaaagctaagtgctcaaaccccgttccatggctctgctgctttctggaggacatctccggta

SEQ ID NO: 322 - DNA, 441 bp, Artificial Sequence
  Locus number 31 amplicon
aggaagaacggtgtgttcaaagctctaccatttgtgtagaaaagggagaaaaacacgtttcctttgtgtgtgtcaaaggcatcgaatgtctggaatgatccagcaccggctacactggttgaccttggaggaggagaggcggggtggggatggggatggccgcagggaccatacctgtttgtaccttttgaacgccgcagcgggtggtgagggtttacggagcgggggaggggaagctgactccacgagcccagacccctgaaggccagagcagcggaggtggagggtgttggccggggaggaaggaagccccggctgagccttaaagagaccctttgtttcccgggaatcccagctgggccgtcctcagccccgactgaggggaaaggggggctcccaggggttctcattttaaaggcacggaggtcagattgcagattt

SEQ ID NO: 323 - DNA, 440 bp, Artificial Sequence
  Locus number 32 amplicon
tgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaacacctgcttcctctcgttgccttgtgtgaaagtcgcgttgtattttcctgcgcttggcgctgcgcccgcggagctcagggccgtgacccggtgctcgcagccccccgaccccgcagcggagcggcggcttacagacctggggccacctggagacgccgggatgggaccgcgagggcagctccgcgcggaggtgggaccggcgggttgggaacggagttgg

SEQ ID NO: 324 - DNA, 448 bp, Artificial Sequence
  Locus number 33 amplicon
ctgcactcaaatcccaacagatgaaagggaggagagactgacagatgcagtgccttcctttatgtaacctccttgatccaaactacagtctgacccatgctttctggctttatattgtaccactacgttcctaactcaccctcgttccaatggcatcagcattttctcttccctcaaagataatgcacttctgacttttgcatattatggtagccagcccccaggagggctcccagtgattctcacctcatggtacccatgctcctgcgtggtcccctcccacatcgaataggaatgacttgtgtagccaaataggacatggcagaaatgactttgtgtgaattctgagccttgtttattcttgtcctttcttgctacaggcaaagccaaatgccgtgttgtagggaagctcaagtagcttcatggagaaatccacatggcaaggaac

SEQ ID NO: 325 - DNA, 545 bp, Artificial Sequence
  Locus number 34 amplicon
ctctggatttccaccctcctacccagggcgtgttccctgcccgtgactcagcctgtgatttagggcgtctgcagggtgaggtgggtggaaggtgatgcccgccccacctcacaggaattacagagcggtgcgcttacctgcgggactgttatgtgcgctctggcacaggctgactcatgtgtgaagtttaaaggtggggcccctgccgcagacagccttcctcacctgagtcaggcaggcccgggcactgagcaggaagggcaggtataagaggaagaggcagaggttcctgcgcagccagcggacgtccaggaaccgggatgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccaggtaacgtccttttaagttttggtttgtgatagggaagagtttccagctttgtga

SEQ ID NO: 326 - DNA, 570 bp, Artificial Sequence
  Locus number 35 amplicon
ggactgaagttcgagttggaagcacgcgttctccttggtgaagtccgtcctgtcccaggagggctgcgctaggtctctcctctggctccccctcctcgggtcctcgtggctctctgtcgtgtgaagcggggggtcaggagcgcacaaatgtttatactccacgtgagtcacttgcacagatgacgggtgatgttttcctcgccaaggctgatggcaccgggcccctttgccgttccagcctcagtcacgcctccagtctgttagcatttagagttgctgaactttcgcattggtcaggggcgcgggcagcttgctgaccttttctgggagtcgtggcggacggagtggagccgtctgtctcgtcacagacaggcggggctgcggctggggatggccgccgcccactcgccctcagaatggccctcagcggggcttcctgacccctcagccccggtaggaagctggtgtgcactgcagggagaggcggcagctggaaaagtgttaaggccacagtggtttttccagaggctcgtctggaatgccgtggctggatctgagcctcctgacatc

SEQ ID NO: 327 - DNA, 412 bp, Artificial Sequence
  Locus number 36 amplicon
ttccctaactcctgcccgtagtcccacccttacagcccacacttctaattctagccccgcctccagcacggcccagcccactactggccccgctcgcgcctagctccagccccacccacctagccccgcctactcaagctgagccgcccctcttccagccttcgctccgccgtacccggccccgccccggccactcaccagcgtgtccttgttgctgtaatgaaccacccaaccctcccgcagcgtggtgctggatttccgcgtcgtgtgtcgcaccgattgcaccaccctcattagggggatgtaccccagggagctgcgaaggaagaggaaggggtgagaagtcacatgcagaaagtgaccatgctgcttgggaatgcagggggcatctctgggaaactagggagttggg

SEQ ID NO: 328 - DNA, 465 bp, Artificial Sequence
  Locus number 37 amplicon
agtttccatggctggcttcataccatccaccaaaaatgcttttccccctgttccccccaacacacacttgtttttcctcctcttccttttcttttggactcccctccgtctcttatttacacccgtctgattgagaggctctgttcttcactacagtagattacagtcccttccaagatgcaaaagtcttgtcagcgtcaatttcgctctgcctactggtccataaagacagctgccaaggggcaggcagccatacgtcaccgaggatcccagttagaaaacagccattcggcgcccggtggtgcctacagtctcaatgcggctccagtgggagttgggggtaggggggtgggggagaaggacctgctccccaccgggctcttcctccttgctctctttcttaagatctcaatctcgatctctctctctctctctctttctccccacctcatttcttctagccaa

SEQ ID NO: 329 - DNA, 465 bp, Artificial Sequence; identical to SEQ ID NO: 328
  Locus number 38 amplicon

SEQ ID NO: 330 - DNA, 499 bp, Artificial Sequence; identical to SEQ ID NO: 314
  Locus number 39 amplicon

SEQ ID NO: 331 - DNA, 445 bp, Artificial Sequence
  Locus number 40 amplicon
gtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacgcatgcctgcttctacaaacccacaaatggtttccgatcatttctgaaacaaaatggatgctcatttattcatgtgctctggcttctgccttcctctctaatctcgttgcgtatgggctccagctcgccgttcggttctcccgaggcagcatttacacttgagagtctcaagattattttattcctgagggagcatttgcacttgaaagtctctttttacgtttattcctgaggcagcatttgcacttgagtttctttctcccgtagcttgca

SEQ ID NO: 332 - DNA, 556 bp, Artificial Sequence
  Locus number 41 amplicon
gatggaaacgttctttggtccaccaagccctatcgttctgctctttggaaattctccctcactttcttcataatgccgtccttgactaactctcctctagcaatactattggttttgtatgtgatttaaaatcattcctgtaatttcttctgtttatatggcttcgtacaagagattcacattcaacaaatagaaaaaaaacgctattgacatttggtagcttcgacaattgtaaacacatgtgggtttgctgaatacacattaaaatagcatgaattaggatatggtaaatctgttgcggtcccaagttggtgggtttttctaggaagagtcagaccctttaaaaggaccttttatcatctaccaaacaaatccttcatttattaattcccaaggttttctccatcggttggcttactgtcatggaaattgatcttgttttaatagctacttacttttttttattctaatcaatgatttcatttgaaaagaaaattttcaaacatggggaaagctgcaatataagaagaaaacaatggagagacatcgtcactgg

SEQ ID NO: 333 - DNA, 431 bp, Artificial Sequence
  Locus number 42 amplicon
cttgaccagacggacttctctccccgccccaaaagtcacatgcctttcagacacccagaagtggcacctgctccacctgggggcatctgtccgagtcagacgctcggcccccttcgggctgctccgagaaacccagccagaaccacgttggagaaattaggaacctgctgctgaatttcaagccgatcggaaccgccccgctccccttcttccccccataaacaagtcgctggacgaggtgggatctctgcgacccccgcgtgcccggggagagctcccggggcgagctcccggggcgtccttacctggggccgagcatggcttggccgcgcgcaggcaggagcgtcacgcggacggggccctgacctttgccggggccttcgcagcagggcctggggcctgggcgctgctcgttcagaagtggctcattt

SEQ ID NO: 334 - DNA, 600 bp, Artificial Sequence
  Locus number 43 amplicon
caaattccgtgttcagatccctcaggggccagtggtctaaatgccaagagagaaaaatggagggtttcaactcacctcttcaagcgactgtctggggctctccaagcagcagcaggcaggcagctctcattccttgtgggtgaaccgagcagctccttgggccgccggagttgtgaccagcctcaacttcggtgaacaggtgcctggaggaaggaggacggcattggtcgctccagaccaggaaatgggtgacatcacggaagccccgacagataaagcattgctgagaccttagggattgaaagagtcaggaggccccgcccacctgtcatttacctgaatacctgcaagcaggtaggtggcgtctctttgtggacaaataaatcagttagagcaatttgccaggtggaatttactttctttcctgagcacagcacgtgtccagccccgtgttcagatctgaagtcaaatgcctggttgtttcccaggccctcccctttccccatatctgcccacaaaggagttaaaagggaagtttaaacaccaaaatgagacagtaatttagcagacacaaaaaggaagagtgtgaagccgaacttc

SEQ ID NO: 335 - DNA, 567 bp, Artificial Sequence
  Locus number 44 amplicon
aaatgtatcctcccaaagcagggaaggtaggtggcagcaacagcagcaggaatgctttgtcgctggtgaggccatctctctcccgccaagctcagcaccacatgcgcgcacgcgctcacacacacacacacacacacgtgcacacacaaagggagagggcggaggggtggtctcgcacacagtcttcagctcctattagtcctcctctgatctttagcagattaattaggaagtttgtcaggaaccagccgtgaactccagccgctcctctctgggagtggtaacagtgccagcgaaatctaagctgcaggaattcctctagccacgctgctcctatgattaatgatagaaaggaataaaaaaaagaggggtcaacagctgagtgcaaagcaagttgctagacagggagtaattaagatacttgggtaaatatgattaataagctcaaactggcagggtgtgcagtaaacaaggactaaccagatggtcccctctcttaggagaaggctgggcacttagaaacaagggggaatgggggtgcgggggagactgaaggaggagggaaag

SEQ ID NO: 336 - DNA, 587 bp, Artificial Sequence
  Locus number 45 amplicon
ctgcatttaaggtgagctgtcccttgcctcctccttccccagtgctcgtgtgctgcatgcagtgcgtatcttgcttctgcgagcctaagatggcaggcaggattagccgtgcttgtgctgtgtgtgcatgctgtgtctagaattcattacacgttgcctagtatttcagatgtgagtatgtaaatgctctgtatgccatatcatctggtagcgaagacttgtttttgcctcattacagccttagatatttcaacatcacctttcatttccaattcatttgcttctggatgtttgtttttcatcacattcaaaatatgattttacctttttttttttaacaaaaccaaaaccccccacaaaccctaaaaacaaaaacaacaacaacaaaactctgctaccagatggtgtctctcctttcttcgtgcatttgctgtcttttaaataatgtatgttgtattgttaattaatgtgaatatcaaattaaacacttgaaacttacatgtttattatgcaggtaggaggcaaggtggattctatttttaactcttatgcactccatcatgtgcaagcaacttgggttctcaaat

SEQ ID NO: 337 - DNA, 530 bp, Artificial Sequence
  Locus number 46 amplicon
ttctctgaggcggtattcctgacgtttggatttaggctgataagtgacagtgagttataatcatccttgcctgtgttgtccttcccacgttaggtctgtcatgccacgtatgtccgcagtttataacaatctctatcatacattgaaaagttttgaaaacttatccagtgaatccctgagcaccaaatgttcttttgtgttatttttctttattaggctattattactttattcagaatctctctgttttagagagagcctttctttcttgcctaacctagagtgcagcggcgcgatcatagctcagttcagtcttgaacccctggactcaaccagttctcccccgccctgggcttctgggcgtcctgatctctctcctgaaacccacggggctgggaggtgggaggagatcctactcctagccccatgagcgcgctccaggcctccagattggcccgtttcgggggcagggcgggccgtggggcggggtcgcagcaaggcttcccctctaccctctctgggcctctcac

SEQ ID NO: 338 - DNA, 510 bp, Artificial Sequence
  Locus number 47 amplicon
gaagccggttcacacccacccgggcctggcacaggggaggcgctggctgcagggtcggggcgggagcagcctcaacccggctcctgggccgcggccgcagcagtggaacctgtcggggcaggtaagggcgggcagcggggaggctgaggcgcagggggaggcggctccctgcaggggggccctcgccagcccccgccgtggccgacgtggggcaggggcgcaggtgacagatgggctgtcgccagcctggccagcgtccaggggagctccggtcactgcagacacaggctggagcgggtccttcccccccccagggaaaggtgggcccctgcgcagatgcggctgggtttcgggtgtggagccatcttggacccacgggctgcgtcttccgggcacgggcacagtgtgtgggctccaggcatggggtgccctcagggcagggcctgggcagagggcaggctccgagaggggtcacgttcttgccgcctacctgacagcaggccttctaga

SEQ ID NO: 339 - DNA, 482 bp, Artificial Sequence
  Locus number 48 amplicon
cagtgagtgctgacaaccacacccagccggagtccagggctgtgggagtggacacggcccttcctttcctcgccgaccctttggggcgtctcccatcgggaaatggcagcccctgacctgccccgtggggatgaaacgggctctttgcggggggcctgtggggtatgggcctcctgtcagcagcccgtcccggtgggtggggcttgccggccgcccgcgaatgtcaggaaccttggattcctgacacacgggtgcgggggcgatatcggcgcggagcgggcggggtggcgcccgggccgcgggtgggagaatctggcgtgtgtgtttgcacggcatccatccctccatccgtcctctggagaatttcaacacccacacttggaataaaaaaaaaaattattaatgagcttggtgcggttgccatgggaacctgttgctaatgaatctctggggtttcctgttacctttgccaagtcgaggaa

SEQ ID NO: 340 - DNA, 533 bp, Artificial Sequence
  Locus number 49 amplicon
agatcgccgagctgtcgtagtaggtcgctttttgcatcgcgttgtttcacgatcttgatcgcacactctgacaggggtttgacacccgtgagggcgcacattggcacgcccccgcggtcacgtgacactccgccgccaatggccgccccgcgcagacctggtggggcgagaagcgcagcgcggtgagggctccgcgcaaatccatcttactctcaatagctaagtgacatgaaagccataaaagaaaaagtggtcagcaatatttagcagcacgacttggccccgggcgcagggagccgtgctataaaaaaccgctggaatttactggcagctacaaatatttgcttaacttgcgtctggagttgggggattttccggggagaaggagaatgagtgagggctgcaagctgattctcaggagccgggatccaaaaggagaaaggcttgataggctagaaaggaaaaaggctgggatctttcttttccagggaagaagaaacttggggtgtcgcttagtttctgctccttggcct

SEQ ID NO: 341 - DNA, 470 bp, Artificial Sequence
  Locus number 50 amplicon
cctcttcaggaagaagccgtagggccaaggaagggatgggtgacggggctcacaccattccagcgctgccctcgaactcgcgggcctccgttccctttgcagtcacttggtgtgcgccccagtcccgggcaacattactgcccgcgggcgccttgtgtgcatggctgctgcctgcggcgcaccggcctgagcctggagggaggtgcggggcgggagaggcggccctccctgggtctcccctgcctgtcacatctgcacttatttaaagctcggctggtggtccgcgctctctggaatgccagttgcgggcctggcctcctacggcatttgcactgattagctagcgggtcatgggggagatgaggggcttaggggggcagaccggaggttcacagtattccgcctgcctctgtcccgcgtgctaatcggagcccagtgattcccgctgcaccaatggctgagtgtgttag

SEQ ID NO: 342 - DNA, 551 bp, Artificial Sequence
  Locus number 51 amplicon
aaactttggagatgacggctgagtcctccgggcgaacatgtcaagccgattgtaaatgctgttatttccacatccttcagggacaccagtccctacgaagaccttgggcgattttgaagtgcgggcacctcgattccccgaatctgtagtgtggctggtatcggtgttcccctggtttaactagcctgtttggtaagtaactgaatattttttacggcgtgttcagagcttattttccagtttttatgaacaaacatataaatatatctctgcattcctgcctccctcataaaagcgggcatctgtggaaagcaggtttagttatcggaggggaaccattaaacgccagtttaagaggcaggccgggaggacggctcgtggatgttgagactgctggccttggtgatcttgaacgcattataacggaaaatggatctccacttgtaagtcaccgggccgcggggcacccgggccgcagcgcccgtgtggcatgagcttcttgagaaggctcacgtgcggcgagggcgggtggtaaatggcaggagctgaaa

SEQ ID NO: 343 - DNA, 587 bp, Artificial Sequence
  Locus number 52 amplicon
cgtcttaatgcaacaaacgaaaccccacacgaacgaaaaggaacatgtctgcgctctctgcgcagcgcttgggcggcgcggtcccggcgcgcggggaagcggcgtctccgctaaccgaggcgctggaaggggaaaagcgaatgcggaatcgtccaggactccgaaggtcggggccgctcgcgagcaccgaaggggaggagccgacgaagaccaggagtgggccgcatttcggtactgtttccccgagatcaggaactttccgggtctaggagcaacgcctggagggggctgtagagacccagccccccgggacccgcaactacaatgggccggagcttctaaggtcgcctttgttctggcaggaggacggggaatgaggttatctccgccgcctgtcctgcctctccctctcctagccctagggccctccgcccagccgtccggccctgagcccctggccggcggcggcctctccagcgaagactgcggctcgaagactgcagctcggaccccgggtgcttcggatccctagctcccacctccagctccctcattcctgggaatctcttgtgctagttcccagccat

SEQ ID NO: 344 - DNA, 592 bp, Artificial Sequence
  Locus number 53 amplicon
gctggtattggctgtgtgtgaggttttgttttgttttgttttgttttgttttgttttgttttgttttgttttgtaagaaataaatgcacagacgcttgcaaagctccgggctcccctgaagctgcggaagcccccagatgggagcaggcggggagaaaagttggggaacaggcgagggcaagggggcaaagccgaaggaggttgcagcgctggcctggtccctgcccaggcatctactcgcccgcctttgcctctgagtcctccccgctgggctgcgtggaattgatgagcttgttttcctttttccacttcatgcggcggttctggaaccagatcttgatctggcgctcggtgaggcagagcgcgttggcgatctcgatgcggcggcgccgtgtcaggtagcggttgaagtggaactccttctccagctccagtgtctggtagcgcgtgtaggtctggcggcctcggcgcccatggctcccatacacagcacctacgagcagaaacggccgggcgccggtaagccagggcctggagggttgacccagtcagcccagtgcctcccacaagaggcacccagactagaaaccac

SEQ ID NO: 345 - DNA, 445 bp, Artificial Sequence; identical to SEQ ID NO: 331
  Locus number 54 amplicon

SEQ ID NO: 346 - DNA, 577 bp, Artificial Sequence
  Locus number 55 amplicon
atgatcgcttgagcccagataacatggtgagaccttcgtctctattaaacaaacaaacaaacccaggcgtcgtggcgtgcacctgtggtcccagctagtcgggaggctcaggtgggagaaccccttgagccagggagtttgaggctgcagtgagctgtgatcgcgccactgcactccaggttgggcaacagatcgactctgtctccaaatgtaaaccccatgagggcaagactcttgtttggtctcattcaccttggcgtgcccaccacctagaacagggctgatcacgcagtagaatctaaccatataattaattgtgcttgaagagggggtgttggggagtaagagaaggaagggaggagggaagaaatgaaagacttgtgtgtttggattaaatatattaggtttggttaagagtcgttcagtttattcatttgcttgtggcccaattcagtagttttactccctctcccacttggctcctcaggctttttgctcagccctggaaccgcgctgtaattggcagctccttctaaatcgggacccggatgctagctgtaactggagccgaagtctc

SEQ ID NO: 347 - DNA, 513 bp, Artificial Sequence
  Locus number 56 amplicon
gcctcttgagtcttcattgctccgcagtctaggccttgaactagcagagggtaggtgtttgggtggtggtatgctttgggaagtataatgtacaaaatgggctttcacgtgcgcaagtccatttcgggattatttcccatttgccgccctggcggggcagggcgatagggagactcaggccgtcccaccgattggcgcgtgagctgaggcaagaccggagactggtctcccgggctgaactttctgtgctggaaaatgaatgctctgagctttggaagctctcagggtacaaattctcagatcatcagtcctcacctgagggaccttccgcggcatctatgcgggcatggttactgcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctccc

SEQ ID NO: 348 - DNA, 567 bp, Artificial Sequence
  Locus number 57 amplicon
caatggagagacatcgtcactggaaaaatactacgggccactctctataccatcctgcacccccagatggagaaactgagggaagtcgtggcctttcaacactcttgggtctccatctggcttggaagggaacgaaatggctgtcaagagtctcagaagcgcactttccccgtggttcctccgggtaaccctgactcacttttcatctacccatcccctccaaaacaaggcctagccagttccaagctggagaggtgacccagagttgccttctgtcatgtcctgcctttcgtctcgagtccactaaccccactcagactctgtctgctcccacccccaccgcggccagtgaaatcccaatcgtcttccacgtggaaccccaggtccgcagttatgataacggatcacatcgctcctgcggaaagtgcgcgcggtggagtgataattggacctagcgtctaaattcttgttggaggacctcgttccagctgccagttaagcctctgggatccgcagcgtctctaggaattgagagagtggggaagttaggatccaggaggaggatgg

SEQ ID NO: 349 - DNA, 412 bp, Artificial Sequence
  Locus number 58 amplicon
gggcagaagtcattgtttccatcatgaaagtcaacatcagtatttcctgtcctggggacaaaccagtgcctcatgtttctggaaacgctgcagcatttaacttcaattttaatctggataacgccaaagcttttcctcaaattcacccctggagtcagctcatagatgctctgattttgtctaccattgctcctccttaatatctctcgcacaggtgccattgacctttagatgggctgtacggtgtggggttcggtgccatggatctgcttctccagggaccaggatcttgagatcttcaggctgggtttccatggaggcatggagctgcttttcctccttcataactgcactcaaaacagccctgttgctctagaatggagacttgggcaactccttctggcacagattt

SEQ ID NO: 350 - DNA, 511 bp, Artificial Sequence
  Locus number 59 amplicon
ttagtcctcagagcaatcctgggtgcaaggcagaggcggctgttatcaggcctattacacaggtttagggtgaaacttgaaaatgtgggcgggaaagtcacaaagcaatgaaaaaaccatctagaaaaaatcttttctggatgtcaccatctaacatttggcatgagaccccagaaaccggatgactcggctcagaagcagacacatttgaaaagatatttatctcacgataaattaagggacaaaaaggccttcaaaaaggaacggaataaacggaataatttttaactctaacattactttctttcaatttttacataattcttatagctgcggcgagtgaaacgactaaaacaaaagcaaaacagagctccactgcccaaaacaaagatggccgagacgactcccatgcccacacgcaaaatggacgctgactatgacgttccctgcaacaatcctcaactggccccgccccaccaatttggaaccccgcctcctcaacccggaaccc

SEQ ID NO: 351 - DNA, 512 bp, Artificial Sequence
  Locus number 60 amplicon
ctctctgaggcactcactcaggctgcccagctgtcggatgacatttgccagggtgatgttggtcacgcattccagctcgcttctaacgctaggcaacgtctgacggcacaggtgccttggctcgatgttcctcgttactaacggcatggtggacctgcttcaggcaatgttctgaatggtgaaaaacaacctaaaaaagaaataacaggaaagtattactcaaccacaaattccaggcacactagggctgtgtgaatcttttttttttttttttttggtcttaccctgatctaaaacagctttaaaaaaaatcttcattctccctatctttttttttctttcatttttaagtcctctctcccttgccctttttaaggtttgctattagaagatctgctatgtaagtttagaaattatggactggtgactgctgcctgaggtacataggcagcatagaaacattaaagtgccaactactgctccaaccaacaagagtctccagaggcaaggag

SEQ ID NO: 352 - DNA, 486 bp, Artificial Sequence
  Locus number 61 amplicon
cctccaaacttgtgtccaaagctaatttcctcccgttgggcttggctataactctacaagtaaaacagtcaccccgagcaatacgtacaggaactcaatagtaacgtgattaagttcctagtcaacaagactacactcgactgtatgttaacaaacctaattatagccccgtggtaataaattgggccagggccctggctgcacatctctgaggtcatgtctaggagagctgtttgaccctcttgtctcagggaagagaattgtcctggagaggggtccctgtctcagcatggtagaggggctgttttctccctgacctagttgtccagcccctgggaggatgggtggatgccaggaagcatttcagagcggaaggtcatcggcatgagaactgggtattaggatttgctggaggagaccggaagggcagtggcttctgagccattggcccctttcacgttgtgagtggcatcaggatgtctgaga

SEQ ID NO: 353 - DNA, 452 bp, Artificial Sequence
  Locus number 62 amplicon
cttgcagctaggtggtcatacccataggatgcttttgggggcttgctgcttccatgaggatgatgtaaaacttctttatggtggctcccaggagcctctgcaccatcaccttcgccacttcatccaccatgtcagttgcgtgagtccctggcctcacctgatggggctattcatggtcctaaactcattacagtttttccagtttcagacccctgctcctgtgaacccctctaatccatctccccctctcctgcttccaccgttcaccgagctcctggtgacccaccaactgtacgctaagcccttctcccttgaattcacattgtccattgcccttctcgccacagaattcatggttaacgaaatttcacctactccttgagacagagcctctgaatcagaggcctcatgactggattgtctgttactgcataaatacagagacccacggg

SEQ ID NO: 354 - DNA, 600 bp, Artificial Sequence
  Locus number 63 amplicon
taacaagctccaaggtgatgtggatgctgttggtcctggatcacattttgagttataaggctgtaaacccaaccccaacatatatatcctctggggagccattcctcttgatgatttgcctcttactccagaagagactttggctaatcttccaaatctagccaatcatttgaaactcactgtgaatcccatccgctacacactttgtaccaccaacatacttgaagatgttcaagtcctcacgttagaaatatgatcgttttatggtttctaataattgcccagaacttggtatgatgaatcttctttcctactttgcaagtagctctcttaaaatttgctgagagtctatcatttttcagttgtatgcatttacttacaaatacaaatttggatttctaaggttcactttccttatagctggtaatctctcttctgtgcctgggcaggtgctccatgtagcaatctaggcttaggagaaaggagaaaaaggtaggttggtttggtgctcacacatcatgtccccttttaattctggtgctagtggactagagaaattgagaaggaatagattagagtctcctcacttgacatggctga

SEQ ID NO: 355 - DNA, 421 bp, Artificial Sequence
  Locus number 64 amplicon
caatgaccagtgtgaggtcaagggatgtcgtgctcagcttgatttgggaggtggcactgacggggtttgcagatggataagaagtgagtttccccagtgtcaagaccctataaccctgcagcccttctctgcctctgggatgggatctaaagagacccttctaatggtgtcctgccgtatcctgctgtgggcacgtggccccagtccttcacagccccacactgtgtctcaccttggggttcctgttgctgaataaccctcaccccacccccttaccctgcatcccgcaggcctctgacaggcgtgtgtcattcatagggtgcttctcccaggatgctgccaggcagctagaactgcctgagatgctttcctcaacccctctaggtagaagtgagtgtgttcttcccacattcacaccaca

SEQ ID NO: 356 - DNA, 551 bp, Artificial Sequence
  Locus number 65 amplicon
ccatagaggtttggcgttcattcaggtgtaaagttgtgtagagcttcagagtgaaaacacagagaaggggtgggatccctacatgaccctgcaaaagaattttaccaatggaaaagaagactgcagaaaaggaggagcttggtatacaaattgcctgaaatttcagagttggacttcatcacttgtctgtgagccgacgcaggcaggcgtattctatatcaacgacagactctcctctgccatttcctttcctgaatctagttaacattcgggtttaatttaaacgaaaatacatcgctgttcatttgaagagactggctttcccacagttgttctgtactttcctcagattttagagtatttgggtcagaaagggagttcttcccagataacaggaggaattcatgtgagtttaaatattgcaggacttgcatgaagcacctagttagctaaacattgctttctctcaagaagcaaaccaatatttttttttccttaaagtaaaaggcacagagctaaaacctgccccctggacatgcttaaataatgca

SEQ ID NO: 357 - DNA, 445 bp, Artificial Sequence
  Locus number 66 amplicon
taagcagagggaagttgtgaccccagataaagatgactaatgactagggacctgggctgaggactgatggagattggataagggggaaattggctgtggagtcataccttagaccctggttgggtaggaagtcaggatcgcctagatggagctatggagaataaacagagcagaagtgtagtggtctgtgccaccctgaccgtcctgtctcagtctttcccatgtgcttcttaggtgctggtacagggctgcctcttggacccttcccagcgggaggtgttcctgcagcagatatatgagcagctctgcctctttgaggataaggtggccaccatgctgcagcagcagtacgatccccagagccaggtatgtaagagagaaagtgggcagaggcaacttagaaagaggagcagctaaggacagagggcagagaggagggatagtc

SEQ ID NO: 358 - DNA, 452 bp, Artificial Sequence
  Locus number 67 amplicon
agaagtgaggtcggaacaccaacgcatcatctcactgcatggccctggaggctctgccgtttaaagaccccagaaccttccccattcaaggtcctctcctgggcacaggagattggagaaagctcctcccttaattccaggggccgagttccagcccatccaattctccgtctcacctgaggctgctgtggtcctggtgaccccagggagcaacctgccgcccatggctggggagggggtgaagctgtctctttaagagcaggaatggagcccctgggcctcagggcatctgacttgttttctacctgcccaggtttgcttagggcgtggcagcttcggataaacgcaggactccgcctggcagcccgatttctcccggaacctctgctcagcctggtgaaccacacaggtgagcagctggggccccttcctccaagccctccttgtctctg

SEQ ID NO: 359 - DNA, 431 bp, Artificial Sequence
  Locus number 68 amplicon
ctccctccctctctcttctgtccgcctccccttctcccctcagcctctcgcccccctcccagtgtccagcccagagtctgcgccccgggcccattgttagcaggctattccacggcagctttgcatctggctccggcgggaagcggaaaacgggaggcggctctcgaagcttcccgaccttcctgcgccatcaacttctcaggagtggctggagaaagatgcatgtgccaagcgagacaacaaccccaggtccatgtgtccaaatccccgtagccagggcggcggccagccaaagaaatgccgccccgagcaggcgcgtgcggctcctggcattctgggtttcatacccgtagggctcgggtgcggtgagtatttccgatttccaggaagtctgttggaagttaccagcagggaaagagaagatgcttgct

SEQ ID NO: 360 - DNA, 586 bp, Artificial Sequence
  Locus number 69 amplicon
agtgcaagttcaggtgtccacagggcctggcagaatgtaagccttcgatcactggcacctattgtgttactgattctattatcaggtgcctctgcttctggattgtcaaccccaagttgggctctgcccggtgatctgccagctctttaatagaaccagctgggacatgtctgagctgagccccaagccccactcctctgccagtcggatggggttaggactctgggctgccctccaaaaggctgtcaggaaggcgctgagttctggctggaggcagaagtggagagacttacgggggggcgcagaaagaaaaatttcctcttaaatagaggcgtgtatttgtgattctgcctggcttgtttccattcatccttcatgcttcagctcagctagccccttcctcaggaagctctcttgacctccctaggcaggggtggttgcttcctctggactcccagggccctctagggctccctgattccaggcttgatcattgtacccttgcttccctcatcacagccctgaccactctgggctgtcttttttcttttttttagagatagggtctcactctctcccaggcata

SEQ ID NO: 361 - DNA, 499 bp, Artificial Sequence
  Locus number 70 amplicon
ctccatctacatgcattgccttgatggtctcactcaatatcatgacttgaaataacagtgtaaggtaactcctaaattcatatattcatgctcaaaccttcttccaacattcagtcgtaagtcgaattgcctgtgacagagatactttgtggttctgtagacatttcaaactaaccatcctgagcctccgaacctcctccacttgcagcctccccacctcagaagtgggcaaatccactttttgtgtggtctgggccaaatacatgactccctgcatcacgtagaggctgtgctggtccaaagaaggctcaaaagagggcagtttgcgcacacaacgtgtcggggcagggcttccagatgatcattcggcttttttgtgtcttccaagatgatgatccggggaggagggatgtgaaagggggtcagtcgccaggcgagctgaggacccagttctgcgcctttgcctgtgccctgacctgaaggaaagtccctgtctccc

SEQ ID NO: 362 - DNA, 420 bp, Artificial Sequence
  Locus number 71 amplicon
ctggctgggggatctgtctctttcacttccacttttgctctatttccctgctactgtctttcctttctccttgtctgtctcttctcctcccctcagccagcatctgtctgtctctgcctttctctcctgctccctccctccctcctctccagcaccttccaatgccaggtggggctgccattccttccaccttcccagtgacccgccagtgtgactgccttgagaggaaagtcctaaactgtccctatcttcaccagcctgccctcaaatcattggttcaaatcgctgtcgagaagtttgggagctcccagggcgggggctttctaacagctctgcctagctcgggcctgccctcaaccgcagcatgcagggcagccacagacaacctctctgcaacttctgatgcctccgtgcccccat

SEQ ID NO: 363 - DNA, 497 bp, Artificial Sequence
  Locus number 72 amplicon
cccgtagcctagagggagggagagtcgcttaaaccacctgatgcagaatgctgagtgcggagaccaggaggtgggtgcatcacagagggtcataaaggacatgagctgcgcagtacaggaggtggaaggagggggtcacacgaacagatgtcacccgaggcaagtccccaactctttcccagctttcaaagcctaatttgattaatatagagcatgcaccacctgactatacctgtcagagccagaacttacaagtaagacagaaacaatgcctatggccttcagtcatgctaaggcacctatctgacaagcctgccaaacgccattgaactctagtagttttactatttacaatgaggacattttacaactctttttaatggaaaagttaacttgtagaaaactaagctgaaagcttattgtgtgttagcaagacaaatgtttttccagtggggatagaagtgatctcgtcctgtaaaaatgcaaatgggccaggc

SEQ ID NO: 364 - DNA, 541 bp, Artificial Sequence
  Locus number 73 amplicon
accttcttgcttccttcgctacctaagtatttctgcaagcccactttgttctgcagcttagctttcctggcacaattcttatagattttggtcccttttaaaattcattcttcagcaaatgctttctctctccatcttttgactagagatcattagagatcacctgagatcattagagaacagtggtttccttggttgccattccctttcttcttcattgggagtattctgcggtgaactcagacattttatttttcaaagcttcccattcttttaaaaatgcttttccttttacagcctctcgctcaaaatcatacccatcttttccctggatctgttttctcaagtctccaatcgcctgccttctttgtgtcttgtattaccctcacatcccccagctttctactgctctcccaggaccaaccatttcttccgcgggagtcacattacatcagcattcctaatgcagtatctgttatctaccagattctgttttattctaggtagtcacttaaaaacgaacctcggtactggtctgact

SEQ ID NO: 365 - DNA, 540 bp, Artificial Sequence
  Locus number 74 amplicon
agtcttcgctcaacctgatttggctctgctggcagcctcgtccttcgccatcgaacattgcgggtgttatcataatactctgaagggggggaaaacgggtcggggggatgtaggcggtgctgaaatgaccggctttgaagaacctgcaggcaaagtttcgtccaatcgtctgagcctgtcctcttattcccggttgtaactaaatactgttgcgagcgcagccgaagccctttgttggagatgtgtgagcgcagtctctacagagcgggctatgtgggctcgcttctgaatctgcagtcgccagactctttctacttctccaacctgaggccgaatggcggccagttggccgcgcttccccctatctcctacccgcgcggcgcgctgccctgggccgccacgcccgcctcctgcgcccccgcgcagcctgcgggcgccactgccttcggcggcttctcgcagccctacctggctggctccgggcctctcggcctgcagcccccaacagccaaagacggacccgaagagcaggctaagttc

SEQ ID NO: 366 - DNA, 591 bp, Artificial Sequence
  Locus number 75 amplicon
catgtatccgaggaaagcctgagctacaaggcaaaggcatcccatctggaacaaaatcagaaagctattggcaaaggtaatcaatcaggccataaatagccatttacccgcttccttttcggggctggaggtgggccgggagccctccaagggtgagctgggcaacttgtagagcaaggaatatgccctccgctgccggcgccccggccgcttttgtctgggctcccagccgggcttccgaggctttgtaccatggatttgggagtgacaatgggcatttccctcagattcaaggctgctcaacctcacctctgtagggggaaaaaaatcagaagggagtgtcccaaggacctagccattcggccgaattttttagacattttgggagtctcctccgaggcctttaagtgcgaaccgcgcgaagcggccctgcccggggagactcgctgaggcagggctgaggcggcgggcgggagcaagctgctctagcatttgggttctgccctgtggcgtgttctcttccagggcctttccagcatcatcggagaagacgaagcaccctggccgccactgtccgtgctgcgccaactc

SEQ ID NO: 367 - DNA, 495 bp, Artificial Sequence
  Locus number 76 amplicon
agggagtaagagtggttgggtccagggtacgttctgtggatgtctgttgaaggtcttcagcaacctatgtttagaacattctgcagaggcaagaagtttgaaagcctatttgtatggtatgtgaaggccagttctgggcaaatatgtctagagttttataccttaaattggacagaatttgattactgagctttgaaaaacctttaacactgtttcctggatgacttgaatgtacaacaatcacgctttagaccataaatcagcagttgccttttcagcgaaggatcacagtatggagattatatttttcttctccttttatagaagagaacattgaatcctgtgttgagtcacatttttgttgaaaccttgggcccagaccctgctttcccgatgcctgcaaagacttcccgatgcctgcgatgtctttgcactctaccatgttgcttgccattttcttttgttgttcatggtgtgtgtgactgagcaggtgaa

SEQ ID NO: 368 - DNA, 558 bp, Artificial Sequence
  Locus number 77 amplicon
ctagcaggtggtaaagccagagctttgaacctaggcagtctggctctgagtccatgctcataaacataactctgggttattgaggccctttgtatctcaggcttggggactatgctcagatcaacttgggactgtggccagacctgccagggatgatgcagaatctatccagtcgtgtctaggatggaacagtgcaaccagacatggtgggtgactcaggaggatgaagtgattgcgtgagtttagggcagcggggcgacacagaggttaaggtataggcagaagagctctctctaccttttggagagggtgcgtttctggtgctagagattcctgtgccttcctatatcaaggcccaatttagcaccatcatcaagcacttatgaaatgtagacttagagcacaggggtcgagatagctgagagacacggactccacagggctttgacccagttggaaaaacaagatggaataacaattccaggtagcaaatgcaagagataacttttttatttgcacagtattttgtaaatcagtgtccattgtgtgtgtgagcat

SEQ ID NO: 369 - DNA, 487 bp, Artificial Sequence
  Locus number 78 amplicon
ggtgagaggaacctctgagaagcctcgtgcggcttgagtttagagtcacgccctgcccagcgacattctcccgcgcacgggagaacctgcacttccggtctccaaccctcgcgggccgtgactcttcccctcccccgcgccgggccctgcatttccggcccccttgctctcctgcacttccgcccagtcacatggatgatggatagcgttgggagctgttttctctatcttccaggtggctgctgggatcctaaacttgtttctttaatttctctttaaaaattgaatgtcctttagtttttttcacttccttaaatttgagggtcgagaaagctagaggtggagacaaaaggctcattgaagacaaatcttttttggcttttcagatcacttacccctttctgaattccctgtacaaattcataccagtaactgagatttaggcctccagggcctaggccagtgtctgcacttagtaggcacgcaa

SEQ ID NO: 370 - DNA, 528 bp, Artificial Sequence
  Locus number 79 amplicon
atggcgtttctctgagtcaggtcaaagttaacacattaccttcgcttcaaagactgcttggcttcctttcggtggattagtcaagatgttttgctgactgagactaggaaatctataggagggcgggttagtttacattgttccttgtcattatcgctaaaacactccaaagccttccttaaaaatgcgcactgggctaaaaaggatagacaaggaacacatcctgggccggtaattacgcaaagcattatctcctcttacctccttgcagatttttttttctctttcagtacgtgtcctaagatttctgtgccacccttggagttcactcacctaaacctgaaactaataaagcttggttcttttctccgacacgcaaaggaagcgctaaggtaaatgcatcagacccacactgccgcggaacttttcggctctctaaggctgtattttgatatacgaaaggcacattttccttcccttttcaaaatgcaccttgcaaacgtaacaggaacccgactaggatcatcg

SEQ ID NO: 371 - DNA, 477 bp, Artificial Sequence
  Locus number 80 amplicon
ctcacgttaatcaacccgagtccatcttggtgggattgtcttgctccgaggccctcccactgagctttattttcctgcctgatttcggggtccgctaacaggatgaacagcggaccatacaggcacggtgaaaatgacacttggtgacgtggaagacccagcttgccacagttgaggcagagctcctcagggtcttttgtcttagttatccccgagctatttttcaggaaccgacaggctcccccaccccaacaccggatgaaggccagcaactggaggccaggaataatcaagcacgctctcatttcaaagaggtgacgattgtgcccgtgtttaaaagggatgcctgagaccatgaggatttggagttttggaggcggatctgcctttggggagtgagcgtagggccctaagatgtggttgtgctttgagacagttcccagggtgatgtgtcccatcatccaaacattgcaggat

SEQ ID NO: 372 - DNA, 403 bp, Artificial Sequence
  Locus number 81 amplicon
tttgtgaccggtgtgtcactaggaattccaatggcataaagaaatgcttaataaacaaattgcctttcaaatttggcaactctggggatataacactatgaactgtttttttaaaattctgtctgtataaaagacctggagagcctaactatactgtggattcatttcatcgtaggtcctatgaggtcattgcaaatctttgtactatatttgagaaaacagttgcgctgtccccagcatctaatgtcatgacagccacgaggcctggcacctgatttctccagcactgtgttcacccttgtgtcctgacagcgtaagcagtttttggtgtctttgagagtcatctttacacagccaaattaaacgaaagaagtgaagtagggccttcctgtgttagtcagtc

SEQ ID NO: 373 - DNA, 529 bp, Artificial Sequence
  Locus number 82 amplicon
ccagagaaggtaagagcgcacacgctggaaaacggtgggagcagggaggaacgaccgccttcccgaagcaccgcagggttcgccgcacaacgccgctggtgaggaccgagcgcatctgcccacagcgccccagccgcgcctggagcctcccgctccccagggagaacggtgggcgcgtcccagggaacacgacacccaaggagagggcgggcgcgagtcccaccgggtgacccgctccctggggggcgtgaagcccccagacctgccctgcccctgcctggagattgcgccttgcagggagtgacaacgggccccagccgtcccttccttttaggaatatcaatggaggaaaccgatgtgtcaactagataaaagcagaatgggaaagaggtgcaagcaaaatactctggaatgaagggcaaggggaaaatactctggaaagggactaagcccttccagttaatttcatgtcaataatgttgtcttcaattaacgaaggcacagtcctccttcccgagttgtcaggatt

SEQ ID NO: 374 - DNA, 465 bp, Artificial Sequence
  Locus number 83 amplicon
tgagagcctagggaaaccatctgattagaagagctcccctcaggagcgcgttagcttcacaccttcggcagcaggagggcggcagcttctcgcaggcggcagggcgggcggccaggatcatgtccaccaccacatgccaagtggtggcgttcctcctgtccatcctggggctggccggctgcatcgcggccaccgggatggacatgtggagcacccaggacctgtacgacaaccccgtcacctccgtgttccagtacgaagggctctggaggagctgcgtgaggcagagttcaggcttcaccgaatgcaggccctatttcaccatcctgggacttccaggtaggcaccgtgcaccccggggtagagccaggtgaaccaggtgagcagggaagggggcgtttgcgttaagccccactcccacctctgggtgaggaccctggcagctctggctcagaatgaaaggtg

SEQ ID NO: 375 - DNA, 535 bp, Artificial Sequence
  Locus number 84 amplicon
cgttctcgatccagttccatctcgcacttcccaaagcgtcgcagcgagtggggaccgcagggaccaggcgccgcgaagcgggagcgtgaggcgctctctccgaagccctgggcgacgctggactagtgtgccccggaaggacaggtcacacccgggggtgggggtgaagacgacggtggcggtggggaggacacctttagcagctgggacctgatttcttcctccacaaggctgcagctggctatggccctggtggaaagaaaaagcgagcttgaccaactcgacttgggaagggggatagagagagaaaagaaggaccttgtgtttgtattcataccggtgagcaccaaagaatagtctcacgcagttataggacccaggttcagcgatgtgactacttgtccaaggtcacacagcgagctggggactcggggaccagtgtcggatctcccacccggttgggacttctgagcgcacaggggcaagatatgtgagtaaaccctgtccagaatcccagtcctttgtatcactcggt

SEQ ID NO: 376 - DNA, 540 bp, Artificial Sequence
  Locus number 85 amplicon
aagccagattagagaaggccaccttttggatataagtgaaaaattgtattaaatagattatgctctgctcttgagtaagcaaaaagacttccaaagggtgtacagagaagtttttcagtcttttttaatagaattaagcaaagacatgtgaatgtctattggtcactcctggtttttactaaagaactttgatgatgaataaggaacaattacttataacacctcatgaatgctcttctttaggggacagggttggaatggcagtgggtgaaatgccatcacacatcagtgaagctgggagaggttgactctttaagactggaatgccaaccaggctggataatctatatagcaggggtcacgttgatgtcagttgtgactgattaaaacgtggtgataacactgccatagtcctgggtacaagccccgtgtgtgccaatgacattatatttttcttcagccacaggcttcatgtctcattttagctgatcatccttttacgtacctttactcatgaggctttactggacaacattgtca

SEQ ID NO: 377 - DNA, 537 bp, Artificial Sequence
  Locus number 86 amplicon
tgaggcaagggcaagatcctgttgatttttcggagagtgcatgagtgtagactgctgcaggctgtgggcacagtcagccgcaaacgtttttaggtgtccctgggttttgaatttcattcaacttttctgctctggtgtttatattctctcatctcagattccttttcctctcgctcccactttccatatccacccattttctctcttcctgtacctctatcactagaaatccgtccctctgaccccattcccagcaggcagctggagactctggattctcctggaggattctgctcaggttggaatgtcatagcacactaagggtaaatcgcaaatcccaaggagtacattttcttgaaacacgacaacgagacagatctctacatttccctgggttgaacgtagccagtaagcactgtgaatacacgctcttggttacagggttctggatatatggtgccttagttttcagggcttgaccatgaggacacactgatgagaataccgtaactgaacaaatacttgggttttccggga

SEQ ID NO: 378 - DNA, 425 bp, Artificial Sequence
  Locus number 87 amplicon
agcaatttcgggtgtctttatgcctcagcttagatatctctctggggttcggtgctcctccttggggcgcccataggctgcatctgtccctgacaaggcacacaagatattgaactatagttgcttggttacggacagtcgtctctgtgagctttgagggcaactgccatgtattatgcatcttttgaatccccctagcctagccgggtgctagcccaagttaggtgcttattacagatttgttcagttagcgaatgaatcaatgaataaactggcaattcgtgtctggttcatgggcaccaaaaaccgtgcgaaatggataaatgagcaggtaatggcagtacaaagttcggatctagagaaagatccagattagggagttcagagatgagtaaaacgcagacccagccatcagagaattaaca

SEQ ID NO: 379 - DNA, 449 bp, Artificial Sequence
  Locus number 88 amplicon
caatgccttactatggcctgagcaatctagaccctgcctacctgaggactgagctgaggctcgagcccagacccagacggaaccaagttccatgagaacacgcccttgcaaactcagcctcattactttattggacacctagctgcccttgtaaccatctccccagcagccattcctagtcacagaaggtccccagcaagagcatttgatggacatctgtccttccaggccaggaagcccctgtagcccccaataatgggtcccgtacacaagccctaagtatcttcccagccatccagcttgtgcctctccccataaacaccgccccagcccctggagctggcctgtaaacaaattttctcccctgcgcatatcccactggactgggaggtccagcaccatatttagttaatcccctgacgtcagccttgggtccactcttgcaaata

SEQ ID NO: 380 - DNA, 497 bp, Artificial Sequence
  Locus number 89 amplicon
cattcaggtggtggcagtgtaaggaggagtcgtgtaacgcgtgtcatcagattccagttcagttcctgggcatacaaatatgaagacttcattcctgccttcattgtaacaagtattcattgcagttgggagacagggtggggtgtgagacacacagccactgaatttcaaagcaacgtgataatgctagattatctgtaccttttcaaacgtgtatgcctagaacccaggactgtgcctcgcaaataaaaagtgttcaacaaatactggctgaatgaataaagacagagttgtatagacatagagagggcaactagagcactctgggagttgtaaaaagccttaaagaggagataactgtttgaacttttggaagaattagtttaattcccaggcgaaggaggaataaagacatccctgaatttatatctctcttttccaagaaatccatactcattgttctttatccagccgggattcagacagcaagtcccact

SEQ ID NO: 381 - DNA, 593 bp, Artificial Sequence
  Locus number 90 amplicon
tctaccaggaagaatcgctgctcgtagataaaagtgcattttatttccctagattgcatttatttaattcatataacatgagaaactcctccagtagcgtcaactagggttgataagaataatcgataaagcaaaataaaaacaccttctccaagattttgtaactgcaagcgaacgcatggtggcgctgttgactaagaaggcgaattaaaccacaggcattgtgcatgctcggtgacgcacggatccagtgtggtaaaccagcggttgagagcccaggcagatttttgagccagcaagtctgagcctctggaaaggcttattcactaggccgtctacaaaggttgtggggcaaaagactgtttcccagctctgtctgaggttcagcttggcgacattccctggaagagcgtgacggaaagtgcaatggaggcgggaggagagcgatttcttagacaaaggcaagtcttgcttctctttgtttttctgggagggtctctggctgggtccgagtcaagacgctattctgtggctgaggaaaaagagaagggctttttaatagccaacctagcaaaggatctgggactaagggt

SEQ ID NO: 382 - DNA, 577 bp, Artificial Sequence
  Locus number 91 amplicon
ttcatctgcagtcagacaggtcctgaaaggaacactccagttccacacacactcccccagcagctgttcccacagcagtacccacagacacccagaagtcacgtagtgtgaccctcggatcttcgggccacgcgagtaccccgtcacacgcacacgcgcgtacacacacacacacacacacacacacacacacacaaagtgcccctgggagtgagacccaagccagatccaccaagacccgcaggggcccaataccccacccgccgcgcgcactgacacccggagagagggacgcacagcggctgtgggtgaagcttcacaaaacccagtcgatagacacacgcacgagttgtacacaaagccttggggcgcgcagatacgcacacgcaggtccacgctgttgtacccaaagttgcgcgcagaaagccccagcacgccggctgcccaccgcgcccgctcccgccggcccagtccacaccccctgctcctgcccttgcccacagacgcgggacccggaaggccgaaccggaccaggcggaggcccggggaggccgggtcccctggtcgcatgtccttc

SEQ ID NO: 383 - DNA, 461 bp, Artificial Sequence
  Locus number 92 amplicon
aatccagatgttaaagggaggcggggaacaggggcgcggagggagagccccaggggaaattggagcgagggggtcgtagataccacggacagcggcggctgcgaggcgtttcagcaccacggagagcgtccagacctgcttttcaggagcgcgaagagtattgctgtttgttaaactccagcgtgtctgttggctccctgcggcgctggggaggcacgtttgggggtgggtatatttccttttttttttttttttttttaaacccctgtttttctgtttaaacggccagctccctgcaaggaaaaaaatcttctgtggagatcagagcgctggcctcggaccgttggattgggcgagcatcttgggtaaagagaacagagctttatggctctgggccggcctgagggggttaggggcgaggggaaagcggttgacggcgctgccttcagttaaatctcgga

SEQ ID NO: 384 - DNA, 509 bp, Artificial Sequence
  Locus number 93 amplicon
ggatatcgctcttgtcttgtgggaagaaagctgccaactctttttacccatgagtcctccccaagaaaagaaaggatgaatgtaattgctcagagaacaacactcaccggaacatggcttactaaagggcagggatagggtattgcagggttagggcccgccacttaccactttctctttgcatacctcccagacacccccctttctccctcttcagtgccctataggcctgtgggcctcacccctcgatggctatctcaaagtcagacctgacctgtaagtcaatagtctttggcagatgtacagaactgaaattcgaatggcgaggatggcaagaaaagctggcaacttctatgtacctgcagaacccaaattggcgtttgtcttcagaatcagaggtatcaatggcgtgagcccaaaggttcgaaagatgttgcagcttctttgccttcgtcgagtcttcaatggaaccttcgtgaagctcaacaaggcttcgattaacatgctga

SEQ ID NO: 385 - DNA, 405 bp, Artificial Sequence
  Locus number 94 amplicon
ctttatatccggcaatttagtggcaactcttcgctttccaactgcgcactgagtctttcggtctcctccccattttcctagtcgtcttcggttgtggatgttgtaaactcgaccatccgtctctcaaggtctttggcttcaaggtttcccaatgctctggagctgtccaagccccggtactccggggtggaagacctcagattcatttgacgggcttgtggaggttgggggtctgcggagccccgtgtgggtggggctgggcgcggccggggcggagccggcgaggagccctagggaaagggtgaaaggcacagttgagaaaggcccgccgggcattggtttcacagtttccacgaaggcttcgtgtgcaagcctgaggagtttaggtgcctccctcctgcctcg

SEQ ID NO: 386 - DNA, 538 bp, Artificial Sequence
  Locus number 95 amplicon
cgagcagcaggtttctctctctcatcaggcagagggctggagatttcacctccggagagagtaaaaaggaggatctctgggctggggcaccaggcgtggctgaggacaaaggtggcatgtggagaacaggggcgttaagtgactatttcctcactgcatgctgagaacctcagctttcttctctgatcacttcccaaatcactggcagctactctccacctctcttctctgagcactctgaccagccaaaagggaaagaatgaaggatactggcattcagatttccagtaaacgaccatccatgtctccctacggtgaatcacagttgacaagcccagttcctgcactcagggtttttcatagtcctttactcttaatcaagagcagagagctaaagattatgtcttaggttccctagaaacagaagctgtgatgcagattcagatgcatgcgatttattgcgggcgggccctcagaagaagctcctttttccacctccagaaagagcatggaaaggaactgagcaaggatgtggtct

SEQ ID NO: 387 - DNA, 569 bp, Artificial Sequence
  Locus number 96 amplicon
cgtacctctcctgctagcctctgcctggaagcttggaaggtgaaaaggaagccctgaaagagaggtgcagaccccagccccctaaaacctggaggtgggtctcaagagaaaagcttcacccaggaggagcccggcaggcaccttcacaatgtgcctctccctttcccccatccgtgggggcctggcccttcctcactcccagccccgccacctcatagggacgtcacccaggcgttgccatggccccatgccctggtcagcctcctgctggtgtcctcatcacacctccatgtggaacctctctcgcacccacctccaggcctcatccagatgagacccctgccccttcacccacatggcccttcccaaacggggcacactcagtcattctctaaggacaaagggaagccccccaaccagctttcctcaccaacacatctctcccatctctgacttcctgccgcacaaggatcgccttaaacaagccttacttgatgccaacaacccccgacaagcagagccttttgtcaaaagtctgcttagcctcttgtatgcccacagcaatggta

SEQ ID NO: 388 - DNA, 563 bp, Artificial Sequence
  Locus number 97 amplicon
aattcacaaacgttgccttggagacttattttttaaggcctcagaacgcttggacacttttgaagacgggaacacacggctgaaaacagccctcggacgcgcccatactgcacttcccacccggctcctctaggggaccgaaggtcccaatggcctcttcgacgtggcctcacccgatggctccgcgactcctgcggactcctgtggagtggtccaggcctctgtaaggaggttcctcgattaccctgggtcgattgtgacctctgccaccccccgaaacaccgcccaacccactagtccacacgagcctcaccaaagtagtgaacgaccagacaacacaaaggaaaaagtggctctgaggaaacaggcgccagcgaccaaaagagagaactggcgcgccgcaacgtcacttccgtttggggcattggaaggggcgtggctcgttgtgtgggcagttggacaggatggaactcttcaggattctagtttccctccgcgtgggtgcggaggtatcaaggggtcggctcagtgcctgggtgggcaagagagaaatggacccacag

SEQ ID NO: 389 - DNA, 8000 bp, Homo sapiens
  Locus number 1 genomic DNA region, protein kinase C, zeta type (nPKC-zeta)
ggagtgtgtggcccccaggctggagctgttggcgcagcctctggcacaggcactgcccccatgacggcatccccacccccaggttctacgcggccgagatctgcatcgccctcaacttcctgcacgagagggggatcatctacagggacctgaagctggacaacgtcctcctggatgcggacgggcacatcaagctcacagactacggcatgtgcaaggtgcgtgccttggaccgcctcccctgaccatcccgcatgtgcgtctcggggcgcctgtcccgcggggtagtgtctacaagaaccctctcccagtaactttgcccccacaggaaggcctgggccctggtgacacaacgagcactttctgcggaaccccgaattacatcgcccccgaaatcctgcggggagaggagtacggtgagtgccgctgccctggcccctctcggagcacacagggccagagatggcttcgggcctggcccagcagccagggagaggtgtccttgaccatcttacacccaaaagccacacactgtctttcccagccggatgtcatcatctggcctcagccccttatttgaattctggaaaacctcccatgtccacttgagcagctccttggggagggcactgcacaggattcctcctgccagggagccccggggcacagggaggggaaagacacagaaagcgggggtgggacagggtgcagcacctgagtccccgtgctgcacgagtggctgggggagaagctgttgtctggggagccccagggggtgcaggagcgtgtggacaggaccccacaggccctgcggctgaggacgccgtgcacaccagagtgtttctgctcctctcccctctctgggcgtgaaacggggacatgggcacgcgtgtgcagccgtgtgtgcgtgtgtgaaacggggacgtgggcacgcgtgtgcagccgtgtgtgcgtgtgtgaaacggggatgtgggcacgcgtgtgcagccgtgtgtgcgtgtgtgaaacggggacgtgggcacgcgtgtgcagccctgtgtgcgtgtgtgccgttgggctgagtgttcgtgtgtcgggcatccatgtgtgttgtgtgcacatgcatactgtgtttgtacacactccacccacttctgcatcctggtgttttcaatgaggcatgcatggtgtgccttcagacatttttacacattttttttgccatcagaatgggtgtggggcaggcagggcgggcaggtcactcgccgctgggataactgggctccccagcggccacaatggaagtctcagtagccagagaaggacagacagcagattggaggactggaatatagtctagaacccagcttgggatggggattccgtgtgggacagcggcagcgtctcacctcagcagggaccagggggacttccggggacgcagagacagctgctgtccttgggcaaaacgggtcagggtctcccacccctcattcgctggaacacattcccaacaggttgactacttgaacctttttaaaaaacaaaatggctgtagaaggaaacacaggagagtatttccgttactgcagcgaaagggcttcttcaagcttagttctgtagaagcagaaacgagagaggagggtcgtccgcaggttccaccagtgcctcgtgccggtgtggtcacaggtgccctggcaggaccgacagcccagaggcagcctgggagacctccgtagtgtcagggacggtggcagggaggccgagctgccaggtggaggtgctggttctgtttgggaagtggaagtcacagaggcctgtgtgccgcctgctcaagcctggctcacactcgtgtcaactgggcatgaaaaccaacgccagccaggttcgtcctgctgccggcccatgtggccccactcggtgatggctgtgtgctctcccccagggttcagcgtggactggtgggcgctgggagtcctcatgtttgagatgatggccgggcgctccccgttcgacatcatcaccgacaacccggacatgaacacagaggactaccttttccaaggtgcgtgccccgctgtgcgttcgtacccctcacctgcacgactgtcttccttccttttcaaaggtgcaggtggaggggtcccgcgggtgcctggagcggcagtgccatgcaaagcgtaccgggaaccattcctcctggccagaccctgtgtcacatgccactccccgggccgtggggtggggttaccacacctgtgggtcagcaggaaagagaacctgtccccattcagctccaactccctcctgccctggccagcagcacatgctggagccccagcatgtccttgaccgaggctgtaccgagctgaaagcacagcccccacccccaaaacccacagccaccatcatgggctccttcccacctggaggccccgggacctgctcctggtctggaattcagtgctgtggggatgtgggatctgggaacgcggctgtctccgcggtgccctctggtggccagcctgcagaggcacccgtgtacctgcgatcttggggctgaggaaggggagctgctggttcacgtccgatcctacgacacgtgccagcgcatgtaaccaggaggcccagggaggacccggcgggactccgggttatagatattgctgggctgtaggaagggaggggctccggggccccaaggctgagctcccaaagctcttgctcagagtcagagtctgggcggcactgggcaaatggcacacaacacaggcaagtcctcaccaggctccgcccttgcagtgatcctggagaagcccatccggatcccccggttcctgtccgtcaaagcctcccatgttttaaaaggatttttaaataaggtacgtttctggccatgctgacaaaatctcgtttgtggcctcggtgttggtgggcagagggccaggcacggctgttggccattttttcatgtcggctgctgtgtatcgggtgtgtgggttgattttccgcttcagtatttgagctctgtgttctgtgaatcgtccgtttttactcacacctaacaaaatgagaatgtgtgcccaaggaaaatggaacggagcttaacgtacggggaaggaactttcaataaaggaaacatctgatttccaccacctgggtcagagcatcgggggagggcttgtcagcactgggagtggccaccaaggagagggggtcatggggcttccgggatggggctgacttgtccttgtttgaactctgacctccaggaccccaaagagaggctcggctgccggccacagactggattttctgacatcaagtcccacgcgttcttccgcagcatagactgggacttggtaaagcatcacaaagcctatttgcacccccatccccatcccaaccccaaatctacccaacccccatcccaaccccaaccccaatattcacccaacccccaccccaccccatccgaaccccaatatccatcccaaccccaaattcatccaaccctcaccccaccaccaacccaacccccagcccaactcccaccccaacccccaactcaacccccaccccaatatccacccaaccccactccaacccctacacccccaacccctccaacccctataatctggtggacagagccggggctgtgtgggccgggtgggctgtgtgagctcgcgcaccgccgggctggtctttgacatggccccacttgcgtggagccaaggctcctgtctcccagaagggtcagctgggaatgggggaccaccctccagggccccgaggagggatggggagacacatttcgtcctccggagccaggagagtgaggggccggacgagctcggcccatggcgcttcctggcaaccctcgactgtgctggcttggtgccgccaggagctagcggcacatgcgtcctgacctgtgagcacattggctgttggttccacagggatctgatagtgggggccggcctagagaagggcgtttgctttggtttcatggccggttttatcagcagttactggacaggaccagcagtcgcagcgttcacggcttgagctttagcgtcgggtattgaaggagagtgagtctgtggacagggtgcgacgtacactggctcgatttaggaatctgatttcggtggtgtgtgagcagggtgcattcggtagaaactactttgagttttgaccgttccccagctggccgtatgaggtcagtactctcctgtgatgaggggcggtgactgcagccccagcgggccacgtgatcaggagggggccgaatgtcccgaggggctctgcgtgcagggggttttgccggactgtaggctggcgtgtgtctgtcaggttaaggcaggtaaggctgcgccgcttggtcgtgggttctgtgtggaagtgcagtctccacccaggatgtttccagcgccgctcggtcgtgggttctgtgtgggaagcgcagtctccacctaggatgtttccagcacatggagggtttattgggaggtgaccttgtctgaagctgaggagcgtctgtggaatttgtttccagctgtgtaaatggttgcagagctactgaaataaaacctttaaaatacactctcaaggaaaaaagcagattggatagctcgttcagtgcattttggaggaggttgaactgaatcaggagaaagcccagctctagctctgtcctccaccccacccaacttttccaggcagcctcggccagcgtgggaggtcactccctggcccctgtggtcagtgggggcccttgtccacacagcccaacaagtcactttctagtcgaaggccttgctttgcctgtgcatgtgtgggaccgtgggggaaggtggggagtgaagtggtcagaacgtgcccacaccccttcctacatacagcccttccagagcccagctgggctgctgccaaactaggacggggccattctctgtcgtgcggttgtcagatgcacacacttagaaatgttctgagcataggcacctgccacggaatcaccttcgcaaattcttcatttaaatttatgcctctggtagcataagggagaagagatctgcctttggttctaactgtcagtcatcctcacgcccaggccggggttagaggtggcgtcccttttctctggctcaggcacccctggcctagtggggttactggtggcgttcccctatctcaggccacacctggcctagctggtgttagtggtggcatccccttgtctctggcccacagaacccctccggtccacacacacactcaggtccaggtaccacccggctgaacccgtagcaggtgcttagtagaattacgtgaggagccagcatccccgctcccagccacctcccctcgcccgtctcagctcagtctcccccgtgcctttcccaccctctctcttccaagcccaccaccgtatggggcccaccagcaccatgggatccagggagagcccgatcctgggtgcagccttggtgccagccgggcccctgatcttgtctctcaaccactcttggtttaccgggagtggacagatgaggacagatggctgcctgtggagtgacgggctccttctcttcggagcactgtctaatctgagtgtgagtccaaccctgcccgagccggaactcaaggagaccatgaagccacccttggcctctagctgggagaggtctgcgtccctgcagcgagcacgccaggtgatctctggcacacacttgccgcgggctgtctctcggaaggtagtcagcggccctggcttcccacctgggtcccaccactgcagaatcacccccgtggctgcccacaggggcggcttccatcaccctgcttcttcctggctgctgcgggctgtgttgtgacttccatcccagcctgagaggcctgcgaagggcttgccaccgactgccagccctgcctctgccaccgaccgccggccctgcctctgccaccgaccgccgaccctgcctctgccgtttccttgccacccatcagctcttgaggcttttaggaagaagtgtggctgttttggccagattgctttagctgtcctcagcagggttggtgtggggtcaccaccacccccatgtgaccttggcagaaggaaggtcctcctcccattcacccaacgcctgcaactcagtggttctgagcaatcccagagttacatgacgtcatcgcgatcactttcatcaccctgtacccagagaagacccgaacccactccagcctctccccacaccctgcagtggctgctccgccaggctgtgtggctctgcctggtctgcacatgtcatggaagtggacctgggcacaccgcggcctttcgtgcctgccctcccctcagcattgtctccacaagctgcacccacacagtagcacgtggcactgcctccttcctgcgctgaaccccacccactgcgtccactgcgtggagactgcacctctgcatccgtcctcagtggacatagggtggcctccactttctggccattgtgaattgtgctgccgtgaacacctgtgaacccgcttctgggtggactcgtgctgctgtgagcacctgtgaacccgcttctgggtggacacgtgtttatttctcttgggcacgtgctcagggcgcagttgcaggtccggtggtctcagtctagcctttcaggggggccacctgttcctgcagcggctgctttctggtccctttgggggccccctcagtctgtgctggacttagttccatggctgtagtgggcacagcttgagaacagtccctcggtgggtgtcagctccatgtgggagtggggcacgtgtgaggccttggtccccacctgtggactcagggtctctttcacggactgcggggaaggcagtgggagcagcaggaatggatggtgaaaggacacagtgcccgccccccgagtgtccgagggtagagctgggacagggtcacagtcaccccaaagccgccccctccttgcctatccccagctgaaccagcaccactcaggcagtcgccgccactggggtgtgactctggggcccggcaccgggtccccaacactgctttcctcctggagcctggcctctgcacactgccctggagaagagaggcagtgtgtgtgcagagggccccgtcagccaggcagatccacctgccttgcccctgcactgggaggtggcgctcatcttgtcgggggctcccatgggccgtgtctagaccccaccctccgccggtccaggcacatcctcaggctcctaatcctgagtcctccggtttggctgtgggagcaaaggccgtggggaagttgctgggcctgtcccgggtgagctttgagtgatggacaggctcattctgaaggaactgggtccagacagcacgtcctggcctggtggctggggctgccactctaagagggtccccatccccgcaggatccccggtacttggcacactgcaaagcctgagtatttgtggatcacgtgatctgtgctagtgactatcaggagtctgagatttgaagcgatggatttcccagcatggtcccagctccccactgatgtgaaaggtggtggtgagttaacagctgagccaccacctgctgcccaaccccacgtgtcccacatggccgggcggtgctgcgctaactcatctccccctggatggaaacgtttgcgtggtgacagccgattctcttgagagtcatttgctgcccatgttgctggggagattctgcctcagggccaggagtggtttgctcctcccaccccgggcccagggctgctggtgggaggccccagggaggagcaaggactctaatgcttcgtgtggtgggagcctcaggactttcccacgtgcgacaggcacgttcctgggagctcggtgggaggaacccagccacgttgtgtgctgcgcaaggagccggcggcagggaggggaaaacggaaagacgcagaggagggcaggtgacaagaggcccacagagagatggctgggtctgggcagcg

SEQ ID NO: 390 - DNA, 8000 bp, Homo sapiens
  Locus number 2 genomic DNA region, 14-3-3 protein sigma, stratifin, epithelial cell marker protein 1
aatgtggcccagggaagccaaaagattggacacgcctgtcctagatggagaggaaggaggcagtgctgagcacatctggccattcatccatctggagagagaaggctatgggcaaactgcttcctctcccctgtagacacccagctgggaaggtctggcctttggctaagtcctggcttggggtccttcctcatttcacagaacctaactctatgttagtgctttgtgagtatatgttgatcataataaagttgacgggattttttcacatgataataatagttgtcatctggccgggcatggtggcttatgcctataatttcagcactttggaaggctgaggcaggtggatcacttgaggtcagctgttcgagaccagcctggccaacatggtgaaaccacatctctacttaaaaaaaaaaaaaatacaaaaattagctgggtgtggtggtgcacccttgtaatcccagctactcgggaggctgaggcaggagaatcacttgaacccaggaggtggaggttgcagtgagctgagattgtgccactacactccagcctgggtgacaagagcgaaactccgtctcaaaaaaaagaaaataataataataatagttgccatccattctactgtgctttccattaactcgtgtaatcctcacaagtcccattttatagttacaggaactgaggctcacagagcttaaatcacttggccaaggccacaaacagctataagaattacatttaggcagtctgattccaaagatactagtctattctgtatctcatagacaaacaatacatattcacttttttgttgttgttttgttttgagacggagtcttgctctgtcacccaggctggagtgcagtggcgccatctcggctcactgcaagctccgcctcccgggttcaagcgattctcctgcctcagcctcccgagtagctgggactacaggcatgtgccaccatgcccggctaattttttgtatttttagtagagacagggttttcctgggttagccagaatggtctcgatctcctgaccttgtgatccacccacctcagcctcccaaagtgctgagatgacaggcgtgagccaccgcgtccgacctatattcactatttataaattggagagaataagaaaatcaaaagggccaggtgtagtgactcacacctgtaatcccagcactttgggaagccaaggcaggaggattgcttgaacccagaagttcgagaccagcctgggcaacatggtgagaccctgtctctacaaaaaaatacaaaaattagctgggcgttgtggtgagcaccttattcttaggaagctgaggcaggaggatcacctgaggccaaggaggttgagactgcagtgagctgtgatcataccactgtacttcagcctggacatcagagtaagaccctatctctaaaaaggaaattgagaagaaagaaaatcaaagggaagcaaaatcactcactctcactacctcaagataccctctagaagttggtattttagtgtggttcctattgttttctgtgtcagttctctgatttgagcaaaatctttgggacgtcaaacttaaaatcccctttacttccttggaaaccctgtagcattagcccagacatgtccctactcctccttgtggcaaagagaaggatctcgtctttggtccccagagttctggcctaagcctccctccaggagggaagatgagtgttcagacactcagagtagctgggggagacacaggcctgtgaaattatcctggctcaactattaggtcggcagaatcccagtgaagggagccctacctctgagccccatctaagctttggctatgggtggggcagataagcaggaatccatccctataggctcaatgccaacacccttaggtgaaactcttgatgaaacttgaggccagggctccggcaagcagggaaagaacgttggcaacagaggtctccatctctgaggactctgccaggggtcagagatggggcaatggtcaaaaggaaggaacaggccaggcacagtggctcatgcccataatcccagcactttgggaggctgaggcaggaggatcgcttgagcccaggagtttgagacctgcctgggcaatgtagtgagatctgctctctatttaaaaaaaaaaaaaaggaaagaacaagtaaacttctgagaaacaggctgggggaggcatcacgtagctggaattgctgccccataaaacagaatggtatgtgtcactgccacctccctttctcagtcctctctctccccaggttgctagcgtcccccctgggggatcaaactggactgcttcccagcctcagacagagagcagtctgagtcaggcaggaaagtgggacagccggggagctggaccccaccctctgtgagccccgctggtacctgatggcatgtggcttggagagggcaggtgacctggcgtggagggccagagggtaaatcctcaaacaagtggcaacaggccaccaacttgaaagggaaaattgtgtagtgatgggaaatgtgtccaacaaacctactgggtgactaattacaaaggctgggctggagcttcagaggctgcttgttaaacacttcattaagcggcactctgaaagctgccacctgcgcattctgggagctcagaggggaccctgagggggaatgaggcctggaggatggaaccatcttcaggtagactgagaaggagcctggatctcacttccaaacacagtctggagctcataggtcagaggcctcaatgggagaaaagctaaaggaagagggtgcagaaaggagtttcagggaattggtggctatgtgactttgagcaaatctcacccctctctgagacttagtgttcccatctctatggtcctgtgtgtgtcacagagacatggtggggattaaattcgatcgtgaatatgaaagtgcttgggaaactccatggccctacctaaacatgagttatcctcacctgaaccaaggggggaagttacctggcaggattaggaaccccatcctcctgaacctttatgggctctgtcgaggctgaagcagccaggggctaaagccgtccttagcccctggaagggcactgtgaaagtggatctgatttgagaagccgtttcctgatgtgggcagccatgtgatgccagccccgaacaagagggggcagcctggagcctggaaaggtgccagtgcaggtggggcccacgcccagatttctcctgctgactgttctgatgattcacccccacatcccagcctttttacctttactgcagagccggaaagggtgtggggaagagaggagagggaggcaggtcttgggccctggtcccgccccctgctcctccccacccttctctgggcctggccacccagccaaaaggcaggccaagagcaggagagacacagagtccggcattggtcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtgacactcctcctgtctctcttccagttcttggcgatgggctgggagtgggactggaatctgacttagagaccctgactttggacctctgagttagggccctgaactccctaggtggctcagtggcccgcacgcaagactttgagtccaggtgaggccggggtccggctctctccatcacggcggccccagtcaaactggacgggaccgggagggtcgggtgaacccacaggaggcgccgtggctcctctgccgggctgaggggaggtgagtgggagccacggcgcgggaggctgacgagctctggtggagcggggcaggaaatagtgaagtctccggcgtgagatctaaggacagcgccgcagtagtgagcggcactgagcacccgatttgcaggcgggtcacagtttcatcaagggctcagatctcagcggaggggagtacgatctgaggaaggggtatagcgccgccaaaaaagcctagatcttaggagagggtcacgtcccacagagttcggagatggagacaaaaggaaacgggctgaaggggaggaaggacgagctgggtgggaagggccgctgggagctgtgcctaccgagcccgctgcctgagctctctgcagccagcaacacgccggaacctgcagccgccttgctccgtcccgccttcgcagccctggactggaggcggggcccgaggccaataccgcccaatcacaggagggagctgccccagggtaccgccccgggggcctgactggccaatgggaaagtgagcggcggaacgcgcgcggcgagtttcccgccgcccgccaggcctggcggacaccacgactcgctgactgactgagaggcgcccccgccgcccgctgagcgccgaggggcggagctttcccggtttcactcagacaagttgccgcccgtccggcccgagagctgggaaccctctagagcagcgggacgagccaggatcgcaaaatgcagtgcttgcccgttgagtcatcagctcacccggctgggcctgggccgggccggccgcgggggttggctggaaaaaggccgccaagatgcccccaccacactccgaaatccaagcagccctggacctgtcgccgagaggcttggattgtgtccctggctggctgtgcgaccttggaaaagccgttatacctccctgggcctcagtttccctcttgtatcataaggggcttggactaaaggctaacacaagagtgaaaatggcggttttggccgggcgcggtggctcacgcctgtaatcccagcactctgggaggccgaggcgggcgtatcacgaggtcaggagatcgaggccatcctggctatcacaatgaaaccccgtctctactaaaaatacaaaaaattagccgggagtgatggcgggcacctgtagtaccagctactcgggaggctgaggtaggagaatggcatgagcccaggaggcggagcttgcagtgagccgagatcacgccactgcactccagcctgggcgacagagcgagactcggtccccccacccaagaaaaagagaaaatttgcgattttggactcagacagcctgggtttgactcccagcctgccttggccaaggctcttaatcttgcttacctttgtgtcctcatttataaacaggggaactgaaaaacagtaccttccttttatagttgctgtaaagtaacccataggacagactcaacaaatgttagctttttttttttttttaagacagattctcgctctgtcgcccaggctggagttcagtggcacgatctcggctcactgcaacctccacctcccgggttcaagcaattctcctgcctgagcctcccaagtagctgcgattacaggtgcatgccaccagcctggctagttttcttatatttttagtagagacggggtttcaccatattaaccaggctggtctcaatctcctgacctcaggtgatccgcctgcctcggcctcccaaagtgctgggattacaggagtgagccactgcgccaggacttttttttttttttttttttttttgagacagggtctggctctgtcacccaggtgcgacagtggcgtgatctcagctcacagcaaactcgagcttctggtctcaagcgatcctcccacttcagcctcctagtagctgggactacaggggcctgccaccacacccagctaattttttattttttttatttttatttttatttttatttttatttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcctattttgtttatttttatatggagtctcgctctgttgcccaggctggagtgcagtggtgcaatctcggctcactgcaacctctgcctcctgggttcaagcgattctcctgcctcagcctccttagtagctgggattacaggcatgcaccagcatgtccagctaattttttgtatttttagtagagacgggggtttcaccatgttggtcaggctggtctcgaactcctgacctcgtgatccacccaccttggcctcccaaagtgctgggattacaggcgtgagccaccacacccggcctattttttatttattttttattttttatttttgagacagggtctggctctgtcaccccaggcgtgacagtggcttttggtctcaagcaatcctcccacctcagcctcctggtagctgggactataggtgcctgccaccgcacccagctaattttttattttatttttagtagagacaaggtttcaccatgttggccagactggtctcaaactcctgggctcaagcgatcctcctgcctcagcttcccaaagtgctagggttacaggcttgtgccacctcacccagcctcaaatgtcagctattaacgaatccttccagcttcaataagtctaggatttggccagcatttttatgcctaaagcagaatcatgaggcaggcccagtcctgaggggcagccttattgccaaagctgacctgcacgcctgctgagccccctgagaatg

SEQ ID NO: 391 - DNA, 8000 bp, Homo sapiens
  Locus number 3 genomic DNA region, Feature name CHR01P043164342, Ensembl Gene ID ENSG00000184157
tgtgtcaaaaaaaaaaaaaaaaaaaaaaaaaaaagatggccaggtgtggtggctcacacctgtaatcctagcactttgggaggctgaggagggtggatcacctgaggtcagcagtttgagaccagcctggccagtatggcaaaaccccatctctactaaaaatacaaaaattagctgggtgtggtggtggtgggtgcctgtaatcccagctgctcaggaggctgaggtaggagaattgtttgaacccgggaggcggagtttgcagtgagctgagattgcgccattgcactccagcctgggcaacaagagcaagactccgcctgaaaacaaacaaaaagatgaaaacaaaatgtgggcaggacagtactagagaagggctcatggaaggtgtcttggaggggggagcatctgagcagtgtcttctagctctgagtgataaagcccagctcaagaaaaataaaaatgagtgacagctttttatttttattcaaaatgaaaatagatttattaattcctgtgaaaaacatattataaccggattacccactttatttataggaaaatatttcattaagaagctggccgggcatggtggctcacgcctgtaatcccagcactttgggaggccgaggaaggcggactacctgaggtcaagagttcgagaccatcctggccaatatggcgaaacctcgtctctactaaaaatataaaaattagctgggcgtggtggcggatgcctgtaatcccagctactcaggaggctgaagcaggagaatcgcttgaacccaggaggcggaggttgcagtgagccaagatgtgccattgcactccagcctgggcaacagagtgagactccgtctcaggaaaaaaaaaaaaaggaagcttggcactggttttcacctgcacaaatgttaccatctgggcatatttgaaatgctggcaggtaggcaggccatcacagtcatagaggatttaggagaagagtagcgtaggcagggggaccaatgtgagcaaaggtgcctggggaaactgcatgggaagtggtgggagggagaataacattgatttcgacagtaaagtaggggaaggcaagaaaagaaaccaagaggccgagaggcatgatcacagagggccttatgtccacactcaagcctttgtttggctttatcctgagaacagcagggaacagttgagagttattgagcaagagagggtcattgtcactttgctggctagtgtcagggaagtggggtttactccatccctggccaacctttaagccccagccacctctgtccctgaggttcaaggcccccatgtcataaccactgtccttaagctgtcaggcatggagggagtggggagggtctaaagatgggagctcagagggagaagtggtccctgctaccctctgtccccagctcgccagtcccaggctgaatgtaattgtcctcgatgaagccatcatcatcctcatcttcagccacctgtgggcggcctccccttcctgtctcaggcagtgggcggtgccggtagctggcatggtatcggcggcagaggtggcatttggcagcaagtgcaatgaggagcgagaggaccacagcccccagcacaaatcctaccagcacaggccatgcccgagccccagtgcctgggccaggggccacagcagacgctgtggggagctccgaaggcccaacaagtgctgcagagaaagggacagcattataggtgggccccagagggggctccctggagaaaccaagagcagtgcaggtagggtccttcccccaaccccagcatctaaggggaagccccccacccccatcatcctcccactgtcactcacttttgtttgtctcattcatggaggggcctgatgacaccagtgagtctcagcctcaaccagaaagagccctggctctgaggaggcccccagatgccaggcagccccagggcacaagtcctagaaaataacataggtatgggtgtcagggatggtcacagggtgcactttccaggtcacactcacagccatggtagccctgcacaaactctggggactggacaactgaccacaccagctctccacagaagagaaacaagctgagcctacagaaactggctatttgtaagggaccatcacagggtttggctctggaagctgctaaaaaaaaaataaattgtagaacttactgagcattccttataattcaagcaccaggcatcatgctcacaaaacccagtaaggtaagtataaacattatccccactttatagatgagggctctgaggctgaaaaaggtgaactgactcaactaaagtcttcagattcgaacccagagcccagtctgttgcactgcttggtaagctgaggatgggagacaggggcagaggtgggtcctggctcccgaaggtcagaaaacagcaattgcttggagctacccagccaaagcggagaccacatatggggagggtgatgcaagttgctactgaggacaggggccctggacacagccagagcagccctggcccttctaagttgaaagccgctgctgcccacctctaccctcagcccttcaagcaaacccctgtcctttcacctctactcaaaggaggcccacactctgcccccacagggaggctcaagccagggagtatccaaatgaggatcacctgaatcaggaaattatcacccagggctggggacacctagaggaggaacacttcaattaggggagtagctggaggaagatcatccaggcatggaaacacctgtaggaggagcacctggatcaaaggagtgtctggaggaggcgcacctgaatctggggagtatctagaggaggagcatgaaagttagaagtacctggcagacgaacagctagggcaggagcatatctgccagtggagcacctgaaccaggggagtccttgggggcagagtagccgggctagggaagtacttaggagagaagttgaggggagtaccccagtatattctttgatacaagtgccttcaaaccccccccaacctcctcacatccaacctggtatcaatccccatcatgtcttccactaaacatctctggaatgacaataccctcttctccaccccactgccacagctgagtccaagccaccttcctcttgtactctagccataatctcctaactgggctccccacctctggtctcttccacagagtgatgggcctacaacccaaatctgaccccatcactagcctggttaaaatcccttcaaaagctccccatgccccacagtgccttgcaatccagcacacggccctcaagccaaactcttcttcctcttctccacagttccctccccagcacttcagacagacacacatgccctcctcccactcacccaccctcctgctccctggccacgccctcctcagtttttggggcgccagtctgtcaaggccaaatcagaccatacctgcctgtgaggttgtccctggacctaccctggatgacctgtcaccatcctgcccagtcaaccaccagtcagaaccagtcattgctaggcgggcagctccccgtgggcaacggctggctgaaggatctgtaccctggcgctgcagggagctgggcgttcagcccctcagtgtggtgcttgtgaaattaacgaggggagcgtgagagtgaatatacaggtgggagcgggagagacgtcctgggaaggagaggtcagctgctcattcattcctcagcctgctgtgggcctcatcctagtactaggtccgcaaaacatgagaatgtgttacactggaatgaactgaattcaatttgacgtttctaaggttgtattcctattcctttcctccctgccctgtgaattcttcccaagaagacacacacacactaaccttccaagggtgcatatacactccccaacaggcctctgaactcacagcccacactgatctgcccatcccccatacgcacagcccctccccccaggtcacactttcctccaccaacaaacacccctctgacatgcacagacacctaccccaactctgatgtgtagcttccttcctgctgccagaagccccttgggtactgtgcagagcctgggtaccccctccccggcccccccgggccttctcttctgttcccaccttcaagaactgtgcacaatccgcggagtaagcttccggctggggccggcagaacctggacaggtgggcgggtcaaggcagagcttgactcacctgcggaggcagtgggcggggctgaagctgcaggtctggcagagggcgggctgcggcagcgcctccagtggggagggataattctacctctcccccaagcttttgccaagaactttatgggtgtagacctcaccctcaccccccaatgcttgcggtttgtacagctgggatccagagaagcgtccagcgggccctagaggggcagacacctcagcaggcaggtgctcaggttgataaacaactgaacgtccggtgactggtacaaagtccagagttgaagagggagctttgcaggcctgtaagggtggtgggctggaaccagagcgggtggggagggcattctttccaggcaaagccaggaggaccaagaacactcccaaattgcctacaaatgtgtgtgtaactgtgtagggggtgaggggtggatctggatgggggctcagccttcatctggatctcaggatcccgtgaccccacaagccaggctctgaacctctcccgggtgctctctgattccctttagctttactcctcgtctctgggcctggtgccccctgttcttcaagctccagttcaggaatcaccttccctgagtcctccctctaccctgcaagtccccactcttccatgcccagagcacccactgtcgcagcattcctcattatcttgtgattattcgctctcctggggtggggccaggctttgacagcctgtggctcccagcacagtactgacccagggcaggctccccgtaactacctaagggaggaaggaccgcacgcgccaaggcctggaggccccgaattcgcaaggataggccgggcacagtgggagcaagggctgcagagaggccaagtatggtggctcacgcctgtaatcccagcactttgggaggccaaagcgggttgattgcttgagcccatgagcggagatcagcctgggcaacatagggagaccccatctctactagaaacacaaaaattagctgggcgtggtaatgctcacctgtagtcctagctactggggaagctgaggggggaggactgcctgagcccagaagttttaggctacagtgagccatgattgcgccatcacactccagcctgggcgacagagcaagaccctgtctcaaaaaaataaaaggggggtacagagaggggatgcaaacaaggcatggtagaactgtggctggaaggtgggggccagttcacacttggccctgaagatcttaggatgaaatctgaaccctcagggccatcccttcccacctttcctgcctcctctgctgcagctacaccaaactattttctattttctttcttttttttttttttttttttgagacagagtcactgtgtcacccaggctggagtacagtggtgcgatctcagctcactccaacctccagcccctgggttcaagcgattctcctccctcagcctcctgagtagctagattacaggcatgtgccaccacacccagctaatttttgtattcttagtagagacgggttttcgccatgttggccaggctggtctcgaactcctgacctcaagcaatctgcccgccttggcctcccaaagtgctgggattacaggcatgagccactgcgcccagccaccaaactcttttctattcccagaactcaccatgccctctcctctccctggctctgcaggctctgctcccttctcctgggactcctgccttccccactctccactgcacccctgcagatggtggcccttctcccctatatccctgaacatgtggggtgtgattttctctttagtttccctgccaacctgtaaactctgggaatggactctgcatctgtcttgtttccatcatatcccccatatctaaaatggcaaaagtatacccttctgaaacaaatttgaggaaagaaaggattatcctggatggggcaatgaggtgccaaggagggcttagggttttactttatttttgaagcaaggaaatcatgagattcaactgatattcattgagcacctagcgtgtcctagacactgtgccaggttttcttaaattaaggtgctcatataccataacctaattcatataacataaaattccccatgttagccatttccaggcacacgattcagtagtgtttagcacactcataacgtcatgcaaccatcactctagttctaaaacttcttcatcaccccaaagggatacccctgaccagttaagcagtattccccgtgtccctttccccctggcctctcacgaccattactttgctttcagtctctatggatttgcctgttctggatatttcatataaatggaatcatatttgtgccagctttttaatgaactatttcacttaatccttgtaaccatgctatgagatagatgttaactgtccccttaacagaaaaggaaaatgaggctgtgagaaggtaattggtatgaagtcctgcagaggaaaacaagcagagggtctgctcatccatcattcagtaatttattcaatgaatattttttgaatggccaccagagtcacagccagcccatatgtcacacattgctaaatagcagatggctatctgctgaatggccccacatcatggagaacagagggcagactgggtgtcagcacccgcggctcctcagccaggagctctgatgcagtgaacaacctttacaaccttctgtggcagccctgacaaccatgcagaggctctgtgctagcttctgggacaatttgtgccgccataaagcttccattctggtggataagacgaacaatacacaaagaaataaataagattatttcagataacagtaaatgttgggaagaaaacagcttcatgatagctccatgtgaacttgagaggtgggtgctactttagatagtcagaagaggggactcactgaagagggcatgtttgagctgagatctggctaagagtgagacagtgattgtgccaatatctgggggcagagcattctaggcaaagggaaccgccagcacaaatgctgagatgcgggagcacggctggcttgttcagctacaacaaggcggccgcttgatggagtgcagaaagaggggtgcagatccaagggtctacaccaggtgcatatcaggagctattcctgaggggcctcaccggatctctccgggagatgggaagccactgggggtttgagcagaggactgctgtttgcattgtaaaggaaactgtctgtcttctgcatgaagtacggaccaggggaggccagggtagaagcaggaggccagttaggaggctgttgcgatcatctaggggaaaggacatgtggcagccaggaagtctggtggaggtggggacaagtgctcagactccagatatattttgaaggcaaagttgacatgactggctgattaaatgtggggcttgagaaaaagaaaggattcaagaataactccaaagttttggtctgagcaactggaagactggagctgtcgtttaatgaagtgggaggagtctgggagggaagctttgggagggaaactaggacttcagttttggacacgtaggatgcctgtgagctctccggtagcatcctaagtagagtgtagcatcaagtggcctggatgcaacaggcggtggggactagaaacatacacttaggaaccaacaaaatgtagatgattttcaaagccaggcatctggatgagatcctcaaggacaagtatagagagagaagagccctgggatgtgccaggagtaggggtcagggt

SEQ ID NO: 392 - DNA, 8000 bp, Homo sapiens
  Locus number 4 genomic DNA region, Feature name CHR01P063154999
atccctacccagtgagaaaggccctcctctgcgctgtttccccttgccatggcacctatcaacctgcatgacaaacactgattctcttgcctggttcttccttaaggaaccttgggtttaattcttcttttcattcctggtactttccaggtctacaacagttcaataaattactaataaggaataaatgagtaaataaatatatattgtatacttatatatcctctccccctgaattcagctgtgggtatgacttaaatccaagaaattttggattaaaatgagagttaccaaaaaaggcagctttgacccaaggaaaacttgtttctttaaaaatgttagaagaatttaaatttttaaaatgtgttttggcctggcaggatggttcacacctttaatcccagcactttgagaggctgaggtgggaggatcgtttgaggccaagagcttgagactagcctgggcaacagagcgagatcccatctctacaaaaaataaaaataaaaaattacctgggtgtggtggtgtgcatctgtactcccagctactcgagaggctaaggcaggaggatcacttgagcccaggaggtcgagggctgcagccatctacaattgcaccactgtactccagcctgagacacagagtgagaccctgtctcaaagaaaaacaaaaaaatgtgtttcgatatccgcgatccatgtcacatctgttagtgtacctttagtacatgacttctgcattgtttgctaactgacattctgtgtgaataaagcgtgtatcacaatggtgtttccgtatgttatccaagtgggtcctttccccaggatgtgagtgagcctttggcatggtctttttaagattttgccaagggaagactgggctggaactaaggagctaacataccattgaaatcaaatatcccgttgggtgcactggagggtagagaagaggggattcctgcactcacgctaaatgataaacttttccaagggcagggtcgtgagaggtcttccaggtcacctagtgttctgagtcatgcagaagtaggaaatggacacaatactccccgcagagaatccttcccacaggactgatcctgtcccttcctcccctcccccgccccacacaaggcggaatccccacgcagtgcactgcaggcgcggtggccactgcccctagaaccagatctctcccccagtcccgtcctctccaagctccagatatgtcaaggattcttaagcaggggttttccaatctgtcccttgaggaactacccctgaggcaaggcgggcaggcccaagctgcgatgtggagaattcgatgtccgagcgacctcctcggaggagtgggtcgagttaaatataaccgcgcgaatggaatggcgctaaaaataaggcagcagctggcctgtccacagccctgtcccgggaggggcgggggccccagtggtcttgggcaggaaggccgcgtccggcccaggggcgagaaggctgcggcgtccgcagccagggctggaaggcctgggaggccgcgctctgtgggccccggggcctccattcgggctgggtcgcgggcctggacggggactgtccagaggcatccgaaagccaggccaacttgcctggacgtaacaagacggaagggctgggcgctgaggtcctgccagcccggccgccagagggagctgagcgccagaggaggacaagccgaacccttcaggaggccgggcgtctccggagaccgaagcgccggaggacccgaggaggtctgccccgcgcgctgctctggagactcccggggcgggtggcgctcggcctttccgctcccttccttcccacaagtcccttcccgcgcgcgccccacggccctgcccgccctcccgcgtcagcgccccaaccgtcaagccagcaattgaaacgtttccaaaacggtctatttatttgctcccaataaatcgatcggcggtgattaaagaatcgatgtggcctgggtgggcgagtcgcttgaggggagggattgggggctttcgcccggcgcctgcagggaggccgagggcgggcgcgggcctgagggaggcgtgtcccgcccgggccacacccgaggacccgacacctgggctggcaggccccggcaggcagcgttccctccggcggagaggggcgcgcgcccgccgcctgctttcctcggcccctctcgcctttctcgcgcgccggggaggctgtggccgccagtggctgcggagctgctcagaggcttttgttgctcctcggccggctgaatggggattttgtaaagcgggacagataaaaatgagcagcatcatattgtttgacagaatgatctcgcatgatgaagtgtcggctccgaagggggtgaaaatggtgaattcctaaaaacccagccctgggctcctcctcgagctgccggtagcctggagggacccagcggacagccgggcctggccgcatcgctccaaacggtgtcagaaagactccggctttcaatgccaagtcatttttaagccccgatcctgtccaggacctttctcctcgtggatgaaaagaacaattttcgagagaaaggctcgtttttattaaatccgacatgctgctgataactccatgctaatgtgaaataattaacataatagccataattaaaagcacgctaacaatgccataaatttatcacacaattttactagctttctgcccctaactgctctctcatcgttaattaaacgtgttgccttttacagaatggatgtttatatatttccaatataaataaattcgaaaccatcctctctctcttcctctttctctcctcctttccttttggtctctcgccatttacaggcacgccttggcgtggaccctgagtggcagacatcttgaaaataaatgaagttttgagatgcaaatccaaacaagaacattaaaatagcctctttttttccaccccgaaaagatccggagaggtatacaagggggtagtggtgggtaagagagttgaaaatcccccgctttgggaaatggaagtaatctgggtgggttggggccttgggtaccacctctgccctttcccaccttccttggtggcggccatccagacaaagaggccggtaatagtttaacaaatctatgaagattttcaagaagcagcagactttgattgttgcgggcgcgggggtgttggggagaaaggaggggaatttttctaatagtcccacccacgttttgctccctcttggacaaagagtaactactcttggtgggggacgcgcccttcactccgcggaacctggtcccaactccccgtattgtaagaaaagtgcacccgcgcgcgggcatgatgattctatctcacatcgcgccaacgacttattcaagccactggcactgtctctgacttaaaagaggagaaaagaggcatatgggttcacttgggcctggtgaggggtaggtgggcaattcccgccttccgcactctaaccgtgcccctcctccagtgttgaccacctaagaacccaaaatgagctgtaattaatttccctttctccatcataaatttttctatccatttcttcccccccatccccccactggacgcacacactaaatctcccctcccctggagacgtctcaatttccttcctatcgatccggactccattcttcttgcctcctgttgctagaacctagatccccactccccgcacccctcattcccaccgcgtccaggtggctttcccagcggggtaccatgtactctgcccgctccagaggaaccgaaggggtttcattccattctcctttggttgaaacatttcaaacatttgagcaggtgaggcagctggctgccatcttcctttttaaatctctcctgggaagttcgcttgttgagactcaaagagtcactcaaactcataattgcgtgtgtgtgtctactcattctccctctatctctccaataaccctttgagactcagaaactttttatccacatacaccctttatcacattttcttccccccactacatgtgtctcactttctctctgtatctgtctcgcttcttccgtctctgtcctacagcttggcggtaactgacgacctgtgagcttttagctgcaaactgcaactacgcggcaaacaatttatttagcccgacatctagccggtctccggcaggaccctgcaccgcgtcgggatcggacccttccgctggggcggcctcctgcgtcaaggccagcaggaaccttcctgtcgccctccccggccgccgcttcgcctccttcccgcccccggaggttgtgcaggcgctatggtccgcctggagggagaaagccggcggccggttcctgagccgagagcggccgcggaaaaatcctctgcctccgctggaaatcgatattaggccggcgcgggcgcgggacgtcggggccgcagccagtaggttgtgcacgtctcatcatttagctaatcgagtcgaaaagtttctgtaagggccggacccagcatcagatggtaacactgattgaacaagagattagcacaatagatctctaaccgaggggaagcgttgcttttcacgctacgcgccgtaattaatggtatgaatcaattaatttgacttttattgtgtcgaaggaaaaaagcgcaacaaatggaaccggcagctgggagttgttcgtcctccacccccttccccagggaggttccaaggagacaccggggaatggacggatcaggctgggccgtggcagagggagggtaggaggcagcgaccagcagcgtggagggagtccagagagctagcctctgcggacggcggaatcgaaattaggctcatttggagactacttcgagaccggtgaggggagccctgtagccaccatcctccggcgcgcatccacacatactagtccacgcgggcccagccaccaaggccgcggcagggccagcgctgcgccccgggcccctgcctttagggctgggcaacccaagcagagcaaaggaggttcctgaatgtgtaaatttccgctttttagctttttttttttttttttttggaccttccgacacttcggttgctgaggcagttgcagacgcgacctctgcagtcctgggcgatggccagccagctcagctcgggtcggtttcgcggaaagctgtctagacggcattgtaaacggttcggagcctgcgggccacaaagctgtggagctacggaaatcaactctgagatgcgttttagggccgtgtgcaacctcgggatcatttagataaagaaaaactgtggaggttggcgggcgtctcaggatagtgtcaccaccccctaccctgctcccagcctcagatgagtagtgttatatcctgggaaactgtctaatggggatgaaagtcaatctgtgtgtctcaatgcctgtaatgaagcaagtttacagatttttaaatttttatttttattttattgaattatttttggtgtgtctaggccaaggaaagaggagatcgtgggtggggaaacagactgagggaatcagaagcaccactgtccatccggaattaaatccacatcccagcatcttctgcaaatatttcactaattatttcctctcggaactcctcccctcgtgctccttcctctggtgaggccggcgctcccctcccaggccgcagcggacagacagggattgggttccgtgtgcctgccacaccaggcaggctcttgcggctcccaactaggcggcctaaatgagggaggaaagaggaggcgcatcgctgattcaccgcgtcaagagcactgactttccttggaggtgtgaggtccacgcaccccagccacgcacttgggggtcggtttgcggtgcctccccctccagtcccagtgaaatccccacagtttttcctactatcactgacttgccttgcactccgcgtgcattggccacacatcctcgcctcctccacccgctccgccgccggttttcttggaagttaaatcttggaggatttgtccacaccttaagagaagaaaatccacgttagctggcagcaacggagatcccagcatgctggcatgcccaagtctgcccaggttcccccaaggccatgcccgccgcccgggaagtcactgcccgcacccctcacgtttcttcagccgcccctgggcgctgcgtctaacctgaagacaccaggcctcttcccggatccactcgacttacccaggccgctgccaatcccagctccttccccagcgcctcatttccgattttttcatatgctaagtcgtttaacaactccaagtagccagttatggcttctttatttataggttccctgctattttacgtcgtttttatttctctcggcaactattctagtagattaatcaatagccattttctgaccttcgggaaccccagctgatgctttttgtggccgcacgaaaaaatacatacaggaaaacacgcccgcatcaagccgggaaagagcaggtaggacctgagtggtttggttgggggagggggaaaaagacatctcagcaggtgtcttccccggaatgagcactgaggccagaggggaatctgaaatctaattagcaggagggagccgggtgcgctgctcttactctttaaagctaaaaacaatgaaacaaaaagcaaaacagagactaagttttgctttttaaaacacgatatgggaacctcgttctaggtcgcccagtccctgtctaaggagtgtgacaaagtgggggggagaagggcggaagggagagggggcggggaaggcagggcagcgacagtcgcacagtcccgcggacgctcccaggcccacgccctgactcgctcacacccacccacactcacacccacccgctccctgggccccagggcccggatccagcctgggtgggggggtctccgggcgggccgcagcgccctccgtgccccggggatgctggcgcacagtgcggagcggagttgcgcgtctctcgtccctttgttgacaattccctgaaccaacttgagtttggccggctcggccgcggccctgacgtcacgcacggtcacgtggccccgcctcccgctggatctttaagtagaaagtaatctatcaggccagtccttaaaacgggactttcgactaccggggcttcggcgtccctgacacccagccccctgcccccccgctactgtccctgcccgcgccctcccgagctgctcggcgcccggcgtcccgcgcccgcctggaccgctcctgcgccccacgccagggccagaggccgaggaaggcgggctaagtgagggggcgcggcgtggagaaccgccggggccgggagcggtagcgagcgcctagtaccgagcgccagggacggcaggagttcgcggagcgcggccgctgggggcggacggcagagcccgcgccacgcgatgcggggccgccgagtgtgagctgagcccagcgggccccaagccacctgcggccccctcccctctccctgccccccatctttcgggggcactcaaaccctcttcccctgagctccgtggcagcccccgaacaccctcatcgcccgctgccccctccccgccgccgctaccaaccccgaggagggatgaccctctccggcggcggcagcgccagcgacatgtccggccagacggtgctgacggccgaggacgtggacatcgatgtggtgggcgagggcgacgacgggctggaagagaaggacagcgacgcaggttgcgatagccccgcggggccgccggagctgcgcctggacgaggcggacgaggtgcccccggcggcaccccatcacggacagcctcagccgccccaccagcagcccctgacattgcccaaggaggcggccggagccggggccggaccggggggcgacgtgggcgcgccggaggcggacggctgcaagggcggtgttggcggcgaggagggcggcgcgagcggcggcgggcctggcgcgggcagcggttcg

SEQ ID NO: 393 - DNA, 8000 bp, Homo sapiens
  Locus number 5 genomic DNA region, interleukin-20 precursor (IL-20), four alpha helix cytokine Zcyto10
atacaaaaaaaattagccgggcggggtggtgggcacctgtagtcccagctacacgggaggctgagggaggagaatggcatgaacctggcaagtggagcttgcagtgagccgagatcgcaccactgtactccagcctgggcgacagagtgagacctgtctcaaaaaaaaaaaaaaaaagatttgggattgtgtgtgaatactaagtttaattaatcattacaggtaacttaaaacaatgcaattgggttcttcttggttaatgaaaaggaattgactgacatgactggcttatacaagcctagatttactgaaaatcttgatttcaactattctcatcagaccacatctcccgattttactttaatcacacttatatatgatcatgagaaatggttaacttggcaccaatgatggaaaaataggcatgagcttaaatagtttaagagatatttagattagatatttgtacatattttcaacatttatcaagcattacaataaaaagccatggtctttattttcaggaaactttaagaagatatcaaaagatgttgaaaagaacattctgatccaaaaggtagaaacacaaagagtcattgaatgtcagaacaggaaaagaccttacacactgtttagtctgtttctctcattttacagatttgtaaactgagatccagaaagacacaatcatatgccaaagtcatactgtaatgtggagtctttggactcaaatataagacttcagaattttagatatttaatttttaataagttgataaagaacatatgatagtctctaccatctttatgtttccaaggcgttgtctataattcatcccaggttctttgaatttaattttgtctgggagcatggtcctacatgatggactagtcccagcctaaaaaattttccagtgttattagggagaaaagaccaagttccatgaaacacaggacaacattagatgctttcactgccaaagaaaaatctgctattggaagtcagagaagggagggattggtatagcccagagttgttcaggaataaaggatttgggtttcatctttaatgatgactagagggaagggtggccatgttggagagcaatggtggggatagcaagggctgaggaaaaacagcaggaatgagcccacagtgtctggagttgtggagaaacttggttaaggggaactgggtttagaggagagagcaggagaatcccccagaattctcttccagttcagtaactcagatcttctctatccatcattttatcaagcaggaaggtggagccagaaggaggcacatcctttatccacagctacaaccagtaatcccctcaggcagtgcttcttccaggaggaaggtgttggggtaatctgtcctgcaattaagctgctgtagtgcttgaggaagaacaatgccaccagagaaattccaagggagttccagccctcacctgcctgagctcacttccttcatgtgacatgtatatacagatataaataatgggaagcctttcaacttgaaacaggctcctaggagaccagaagcagcagcctttcctgagctcaggtaagagatcttaccctctactgacactgctcacgttgttgtgaggatcacctacttctcctaatcatttacccaggtatgttcaaggtcacatctaaaggacccttttccacgaggacaaaatctctttgaggacaaataatcatcatgtttatctttgtacttcagtacctagcacaacattcaagacagcgggtgctcattaaatgctcatcaaattgttagttcaggacaactaacatcaatctctacttaaaatgaattgatcacttgctctgtgctaagtgtataaatcatagattattgtatttaaataatcgatttaaaatcaaaacaatttctgggttaagtttaattatcaccattttggggttaagaaaattaaactcagaggtgagttgacttgtccaaggtcacatagaggtagggtggccaactcattccagtttacctgtggtttttccagttttaaaactgaaattttcgtatttcaggaaccattccctgccccccaacctcagtgctgggtaaactggaatgacccacatcaatggaaactagtaaagcgaggatttatttggacccagttctcttgtctccaaacccagagtcctctttgattcttttgggtttggtttgcttttttccttttcctacatttgacagtatctcgagtggtcacaaatgtaaaaaatgtctagcatattgcctggcatataggaaaaattcagtaagtgataatgattatcagtgctgtgccaagctatggagccagccatatatatatggatgtgtgcatatatatatatgatgtgtgtgtatatatatatgtctttataaattttatgtatttatttctttcaaaaatattaaagtatttgagaaaattgaaaaattaaaaagtaggtttattacgactcatgactttaagtttaaatattttatttctgccccaaacaaaatttattataattttactgtcctggttttaagggaaggaaactcatcaataatattttcatcatatgcttttgagaaacaaagttaaccattaagaatgaaacatgaaaacatgtgaatagtggtacaaatttttccttttgcttcaatatggctcagcatggcactgtcgaattttgtctttatataaaattttgatattttgtttgtcataagctttttaattcattttgatattgcactaaaatatttttatcttgatgactgaggttttttagtgctcccttaaattttgcacctaaaatgagtgcctcaattgttttaccctaacctcagcccattattattttatcttaaaactcagcaaacaccctaacctgctctcttactgaggaggctcgcccaagaataaatgagttccgtcattgcctttcttctctgacttttgggaccatttgcttggtctaggacctgagttgcaggtccaggaaagcgtgtactctcgaatccacccaggagtgcctgactacagtcctcctgcagagggcgctgtggagtcccagacacgagtgttaggtggaatcgggctgattgcccatcacgtcttgcctttccctggcagtaggcttgttatgaaatcattgactttctatttgcctctggggcttaagcgaatctgttaccctcaaataacctatctgatctcagacaaatgccaaacagagctcagtttctctgccctgtgggtggccataaaatccagacaatttccccctaggtgttttcgatggcgcagccacagcttctgtgagattcgatttctccccagttcccctgtgggtctgaggggaccagaagggtgagctacgttggctttctggaaggggaggctatatgcgtcaattccccaaaacaagttttgacatttcccctgaaatgtcattctctatctattcactgcaagtgcctgctgttccaggccttacctgctgggcactaacggcggagccaggatggggacagaataaaggagccacgacctgtgccaccaactcgcactcagactctgaactcagacctgaaatcttctcttcacgggaggcttggcagtttttcttagtaagttgcgtggatgggccacactgtctgaggccagataaggctgttctcttcccctgaccccccacccctcaccccgtggacacttggaggaggggaaactcagtaagtcatgctctcttctttgaattcctagctcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtggtacgtaagcgggtatctacctctcctgaaagccttttctcttccttccttgtccgtttctctttcctggcagtactggcagtgtaatcataaaaagaggcaggctggggattccttacccgggggatgtattccaaagaaataactgtagttcaaatatttaaaatgttttgggaaaggacacctcccactagttcttggcagggagtggatgagaagtcttgatattgaagaccctggcagcaggcactgactcatccttgcttgttttgtcttcttctgtttagcaagccaaagatggaaacattgacatcagaatcttaaggaggactgagtctttgcaagacacaaaggtatgtgcttggcccagacaaactctgggaggaggagtggagtgggagcatctccatcaccctggtcttgtctctgctctcccctttcccctcaccaatatacctgtggttttttgcagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctgtgtgagtgtgggtcttgggtgacaggatgcatctcagcacacagcttcaatggcttagcaactaaactctctttcctacctccatttaatggatggagaaactgagtccaaaagttctaataatctgtgttgagacatgtgactaggtaataagaactcagttttattgacttttcggtatatgctctaggcaaaaagtactttgcaaagtctaaagaactataagatgctaactatttgatattaatgataactctgttgtctttgaaattatactttttctgtaggtgaggtatcctacagtatattagtgcgtcctctgtctaggcagtcaattagtagaccattgagcttgacctcagaatatagtctgaataggacctaggaattcaattcttttttttttttttctcatgggggctcaaagagctctgggatagagctcctagactacagctgggggttgtggggaggccagatggggtacggggatggcaaatgccttcagtactgcctgcctatttctaaaaaagaagtgatgagttccatgtttgagcctaaaaggtggcttcctctcctagctgatgatgaacttagtgattccaaatgtgaggtctgaaagagcttttctataggaataagcatcctcagggttgtgggtgaaagagtagagtttctgcctgcttcatgtcaatggcaaaaaatcagaatctgtaatataatctattattctttgggtccttttcagcatgcccacatgacatgccattgtggggaggaagcaatgaagaaatacagccagattctgagtcactttgaaaaggtatatgcgactttggcattgattgggatgggtgtgttttaagaactgagatcataggtaggtgggatggttattcactgttagacatcctgtagccttcaggttcatagccctctgaaatcatgaggaccagcccttgctttaacccaggggacacccatccaggctctagaggagtaccctctctgggtgatgctctggaaatggaaagggaatggccatgattccatcaagtcactacagtgacatctggatcttttagctgcacaaaccagaggcaatagttttacaatgttcacacacttctatgtacctttgaaaacactcacaatttcacacacacacccatgccattcaatttctcaccttcacaccttctcatgtctgccaggaaggcctggatttcactcctcactgactaaatcctactcatcctttaaagactcagcctgggcatcactttcaggaaggtgctggctccttctctcagagttagatgcctcccacatcatcttgtaggaatttcatccctttattcaccacactacattttagttgcctgtttttgccagtctcctcactcaactgtggatagggattgtgccattcaccttttcatccctaaccatcagctaggtgattggcacaatcaatatctgttcaactgatgtgtgcaccgtaggcaacccctacacacacacacaggcacgtgcacacacacacacacacacgtttcttaaagaaaatagcttgattattttgatctctgtgattcaagagtcttaagtagcagttttacttctgctacccccttgcacctcagtttctgtacataagaccagggtgatgaactcaatgatttcccttccttgtgtgatatcttgagattctataacttctttaagtgcttcatcttgaaaagaatgctctgcttacaattgtcagcagacctatccataaaagagataggtcctggagcaaatgctgtctcatgaattgctaaccacatgggtgtgtgtctctttcagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctatttaatgtatttatttttttacttggacatgaaactttaaaaaaattcacagattatatttataacctgactagagcaggtgatgtatttttatacagtaaaaaaaaaaaaccttgtaaattctagaagagtggctaggggggttattcatttgtattcaactaaggacatatttactcatgctgatgctctgtgagatatttgaaattgaaccaatgactacttaggatgggttgtggaataagttttgatgtggaattgcacatctaccttacaattactgaccatccccagtagactccccagtcccataattgtgtatcttccagccaggaatcctacacggccagcatgtatttctacaaataaagttttctttgcataacatctgcttggagtttgcaaatgtttcaagagcagagaccatgttgaggataagtttgaatctcatttcaccccaggtcctcttgctcctttgaggaagaagatgtaggaacctcgatcttctctctcctgcagatttcatcctcagctctatctcctaattcatactgctctgaccccacgactgccctcctctcaaaaggactgtgacagagtgaggggcttcagccatctctgctttcgcctcattggcttggagcactgccctttctatacctctgttttctttctcaccccatacccttgcaagacaaattacaatgggcatgaggcgctattataaaggttaaaaacacacaggtgcaaagtgtaggtctagagtcttgcccagacaggtgtatgagcccccttttgaggcccttccattttggattctgtccagcctcagagtttaggttgttaccagatcaagtccttatctttgtgtccaactattaagtcagtgttttctttccaggcccccttcaggttgagtgtccctggacactgaggagccagagttctggcctgggctggttccttccttcttcccccacctcactctgaagcgcacccccaatttagttgcttagttttctcagtctcagaaacaacagtctcaggctgattccctgggtcctaaagataactctccttactgctttaatttctactccctgttcttagcctgggccctgatatagtttcaatgactttaacttttgataactctcattatacaagtaacagctgcccaacagaaaagaaattt

SEQ ID NO: 394 - DNA, 8000 bp, Homo sapiens
  Locus number 6 genomic DNA region, laminin beta-3 chain precursor (laminin 5 beta 3), laminin B1k chain, kalinin B1 chain
aaaaggctagataaatttattcccccttagaaaaaaaagaagaaacagccagtgcttctcagctttcacagcagaaaaatagctgagatttatccatccccagggttgcaaaagtctagactctgttttataagcaccctgttttgctctcaaggggctacttaggagcagagaagacagctggcttcctggggcatcagagaggcagagggcaggccagtgttaagccaaaagccccaggcctggaggaggagaaacttttcagacaggactgggatcaagggtacatcccaacataggggtctctgacctctccttgcctcccctcccaaaatgcaagtcagcctgagaaaggaaatcggcagaggtctccctgaaatttttagatatgggctcataatttggaggttatgggtggagggaacagccaaaatcactctgttgcctaaaaaaaaaaatttttttaatttttatttttttaaaaattcaatactcaatactgccaggtcccctgatgctcatggagtaatctagacccacagggagtcctggctagggctggccatcttacccaaccctgtcaaatgagcttccccacatccaagtgggtgagatgcaaaaaccacagccatctctgctcagcaactccagtcatttccctataccatctgtgctaaaatagccaagagaacacagggactagaagggcagtgaggcccagaggccatatcagataccaccttccacagcccagaagacaagggcagcctggaaaggggacagataaccccggtctctttccccaaaaggctacagcaactcgggacaaatcactcccttatccattcccttgttcaagcaaaatggctaaatgaggcagctggtagacaagaaaacactgagtgatttcaactttggtaaagaaagattcccccctgttgagggcaaacaaaaagaaaaccaaagttcctataaaaaaagacccagagacaaattagaagaaaagtttgtaaaagccatgactaacaggcaatgttagtcatagctcaaagcatcgtgtttctggatttgatccaacttacatctgagcctctgaccctgctggataagctcaagtcacttcctcatctatctcactgaccatggcacagctcagttcctgccatggcaagaacacagttcggcccacacatcccagcaccaaataacacatgaggctccatacacataaacggccagtgtttggcctatttgcctattcccaagacttgaaagactatcctgcccatgcccaaggactgagaaaagactccgtgtcatctcagagagataagagagaaatgagctatttagttaattctgagtacatttcctcttgcccaaccaacaggtaaattccttagaggcaaggatctggccttatacttttactgcactccccagtccgtgtagtacacagggcttggcctacaccaagtacattctaagtattcagtggacaaatggcagctcacacacccctcccatcccgccttcctccagtcctgggaagtagggcctacctcgccatactgggtgcagtaggtctcaggcttggtcagtccacaggtagatgaagctcggagaaaccgggtcctcccaacaagcaggtccccaacaggtggatagcaggccccacgggagcaggcttgttgggcatgcaggaggccaggcagggctgaaatcacagggatgtgtgatggagcagtccagaaaaaaagggacctcactggccaccccagtatctttcagggaagctgacattagcaagattatatcctttccctcactcaagcttccactcgctgctggcagtaataattgcagtattgatactgttatattttgaaagttgatttcatattccagaactcaaaacttgaaaaggagaagaggagaaacactggcaaccaaaaaccatagatgaccctaaaatatggcttttagaaccagactggagacatagactcggccatcatgacaaggtccgcagctctttccacctgcattgtggcctctgtcagcagcccagaggagggctgactgctgagccattggcagaacattaagaaaggcctgcatttattctgctcctttatcttcaaagctgccccagccatactttgtgagtgcccagctacaattcactggaaaacaggaacttaagccacagtggctctggaaccagcttgagaaaggatgggaaactgtggagagcactcaggaaaccacaaaccaccctcggctgagaataagaagacatttgggagcctttccagagtggcagagaaacttcttccccaaaggcccaaaggaatggggaaatctcacaggtgtccccagtagacaagtattcccaactgaagggactacaggtgacaggtgatgcccacactttggtaaactctccttctccctgtggctgttgcctccctgccatataacagggcctggaaggatgggaaggggtacttaccaaaacacaagaggaagaatggtctcatcttcagccaatggggtgatccccagaaaggacctttcctaggacacagcaaagcaaactgggtacaacagtgcaaacccctagagcacactagccctttttcttttctgtttctagactcaagtatttttcagaagtctttacctagggtcctgatctaggacacttggagcagcagatacatttgtagcttggaaaatgctggagctctagacccttgtctcaagtggcatgtgactcacagggtgccctgggaaaatcccatcccttcccagactccagcttcctcctctaaaatggatgggaaggagtgtggaccctgccctaccccacacagccgtaaggacaacgtggggagcaggaaaaggctggaccctttgcaggagaaaagctgtagaaagggccaagacctagttccagccccaagagagagggctggcttttctcagggcctagaccagcagcctcaacccagccccgcccaaagtgaatgagtcagagtggctgacggcctggaggcaaaccttctcctgtcacgggcatggcctccaataccattcagggccactttgagtttgaggctctgtgcccacaattctgggatgcaacagggagagatgtatggctgtctttaacaagtgagtgagggtttcttctgaaagggaagcaacccaaaatgtcttcaatgatgggctggggctcgacaagaggggtggggctgggaggccacaaagcagggattctgaaggaggctggggaaggatgctcgaaagccaccgtggggtcccagaggcaggcctgccttgtggaaacatgccccacccttgctcatgcagtgacccttctgccttgaattggatgttcactctgttccaatgacagccacaaactcttttggctggggtggagggctgggggcttggcaaggcaggggcggggggggaaattgaggacatttctggcatctttaaattatagatcctaatgcttcaaaatcattccttccaatccctctcctaaaagagtcatgggcccagggagggaacatgtggcctggggtcccacagctaacgatggcctaagagagacccatcttctgactttcatccagtgctttctcagctttcccacccctgactgaaaatccccctgcaagtaggcattctgagccaggccagcccacccttctcacttctcttttgtgctcaaccccggatctgaacctgctttcttctaagccactgaggtgcttatcaaatgtgaaaaagaaatcaaaactgtagcagacattttaacctagctcacctgagtgagctcccaggaagaggaataaatcaggccctgaaaccaggccccaggcatccagagatacagtcctcctcccgcatccggcccgcaccaggcaggtaaagacaggtaacataccttgctgtgtgttctgccgttctttctccagatcgcctgaaagctcctcttgaatgtgggggtctcccctcccggctccaggtttttaaacaacagcctcacctctggagactccctggctgggtgtagccccaccgcagggcgggtctcaggaatctggcagccgtcacacccatctgtcgtcactgcacccccacctcccaggacgggactgggcaagtgggttggtcggtccgtcccagagttcttgtagtgagctccacaatgcccacctgcctgtgggggctgcaaggggcccctcaaacagaaagcacaaggcacatgtaagtgatcatcagagaccagaattcacagggtggggaagggcccttgcatttgtgccaggcaatgaactcagcattttcccaaagccagcaggggtcagcttcttcttgtgacctggaccaccccagacagaagatcaggcagagaacacaaagattagggcttatatagagagttaaagctccagacatatcaccgggctggaaggtgagaagactcaaacatccaggaccctggaaagcaccattcccctccccagtgaaaaaaaaaatgaaaaatcccagcttcttggggcatttggaggatccttaaaaggcaaggttcatcaggaaggattcaaagctcaactcatccaaggaaagcttaagagaaatgagcagagtaactaaatggctcgcctccagctccctccacagggttggcagggagccctgggacaggtagctgcctgtgagtcactcctcccacctgtggggagggttagtctcctagcccctccctccctaggcaggaatgcccgcctggagggccagaaaacagacctgaccacaagtggtggaaggaaaggctgaagcatagcttgactgacaaagtcaaaacagactttccctggcctcctgccaggcctgagaacacagcttcttttgtgggctccttgctcagggatcctgggcttccagccactgtaaatggaagtggcaggtccaaattgagaggctggtctcacaggacactctttcccccaggttagggtcagagagcttttagggaaacctggagggtcagccagtccatatcttggccctggagagcctgcactggcaccgttttggaatgctaggacctcaaagctactatttaaaggagcttcttaactacgattccactttgttagtgtctcctaaacagaaagttctccaccattggagggttatgtccaagaaattggcttgaagacccttaagggggaaatgtagaattttgtggattaaattgggcatttctaaccctcagattcgaattaagcataagttcaggtaggcagaagaaatagtgtaattagcaagtgggcagtgagttgttgatgtaagttgatgcataattgatagtccaataaatgttagagtcttgccccctgtaagcattccagtgaaatctagctcaactcagcaagtaaggtcagtagaagcagtgtcccttcaacacagagagacctccctcaagtcccccaccgagaaaggtcagctctgactctgacacacctgtgttttcagttctcccacctggtggtctctttctctccacttccccaactccctgaactcagagcgctcatgaaactttcgccctctgcccatcaccagaggatgtgacaaagaactcattaataattaactcagcagaagagagcaggtgttgcaatcccagatcctcagaggagaaaaggcagggcaggtgtgcggtgggcctcaccatgagtagctggggccccttaaatcctcctcctcctccctttatctgaggccatgagcccaggtaaatacacattcggtgtctcagacttcacaggcttgggcaggtcctggagtggtttggcttcgcaggagggacatgccaattgctgtgcttggctctcccctacactcccggcaaagtccaggaagctgtttatgcagacccccaagagcagcccagccagcctcactcctgagggacactgatcatttccaagtggggatccagtcccccaagaactccagggctccaggcacaagctctggagcttcagaacccaatttgttcagtcaagtagcctaaaatagagcctgaggccagatcagggtccagctaagattaaaggggtgtggtactgtggctggagcccctcagcctcccctgtgtgcacacctttcctctctccctgcgcccatcctcctacaacagagcacttatctgccctagagccttgacttattagaatgtgtgctcaggaaagtggctagtgaagtcatcccagacttcagtatctttcaaacctcatcactccatcagcaaattcggtcagctctgccttccaataataatcagaatctacttcttccctcctggcctgagcctcttttcctgggacgtctgcaacagcctcctcactgatatacagtcaagtcccaacacagcaggttatgcaccccgagctcagaatcttcacatgcccctatcccactcagggccaaggccagagctttttcagagtctaggggaccctacaccaccttcctcccattactcttcacctctactacaatggcctctatccctgtcttagctcaggcttagggctttggctccagctgcttctgctgcctggaacggtcttgcccctggatatctacaaagctaactctctgacctctttcaaagtctttgttcagatcctaacttctcaatgaggcctatcctaaacacactattaaaattacagccaacttccctgccccatccctgtcccccatcctaacactcctaaccccacctaccctatattttggtgagttatttatttacttatttggtaggggggcatcatgtaccagcttctaaccaactatataatttatctgcttatgtttattttctgtctcttcccaactagaatgtaatatccaagaaggcagagatttctatcttattcactactgttttccaagtgcctggcacatagtaggtgctcaatacttgtggaatgaatggatccacactaaagtacaaacaattgatacagttcaatgcatcccctgtgccgttgatgtgtagttgcattctcagaggggacaatccaggctttgggcactgggatggattactaatagtggaaattcctgtatcagccagagtgcggaggtcttttttgaggcacctatctccaattacagaaatgtcaccatattgacagaggcagtctccttctttgcctgcttctcagtcattcctggcaatgtctctgacagggtgtgggggtggcattataagctactgtgtctattatccatctgtcaggctcaaaccgtccaagtcgctagggagatcagccaagatctgatcaatcagagatcaagggatagggaacaaaggaaggagaaaaggaggaagaaaaggagagagaagaggttcagggggcataggagaacctggtccaggctgtgactctcaggtgttggaggaaggggcaccaggtgactcaagctcaggccacacctgaatacagtgaatcatggctgagtcctcgtctgtgggacagggtggactccaggaacggccctggggatttgccatgtgactaaagcttgcgttgccctgcactacaacacaactgctcagctgtccagacaactggtcacactcttctctgtgcctccccaggaaccagggagagaaagtgggcctggtgtgttacggaggcacagataggagcccagcctcaggagaggggaggctaagcaggacagaagtcgcctgtcatgagtgactcttccatagcccttctcctctccccaccctcacctatccaacctgaatgtttacccagtggacaactgtgcatgcagcttgagcccgaggactgggagcaatcaggcaatcggcctaaaatcactacagctgatatctgctgagtgcttgctgtgcccaggcactgttctgagccctttgc

SEQ ID NO: 395 - DNA, 8000 bp, Homo sapiens
  Locus number 7 genomic DNA region,  Feature name CHR01P001976799, Ensembl gene ID ENSG00000198504
gtctgtgtttttttaaaaaattctcttaacctcacctggactgtctctatgttaacatgaatgctgtcagttgtgtctaaacctcaacagaaaggggtataatgagatgtgtctgactcccaccctatcatggccagaaactcagtttttaaggttctatggggtcccttttaccaacagagtgtctgtgcagttggttaggggtgcttaggattttatttttagtttacagtctctaaatcaggagacacagaccggctggcctatttgtagatatgccaattagcatccagtgaaggctggccccgggtttatgtgaaatgaggagggtgaaaccccaacctgcaagaccctgggcccaaattgcagtagcaacaatgccaaagttgcagcatttttcacaaaacaactctcacctattattttccttgaatttcttgtcatagcaagtgcggaagattcaccagaaccatcaggcagaaccacacatttgttttcagaaatgtctttcctttctttccacaatgttgctttggcttaaatgtttgtgtcagagacgtgtgaaccagagcaactccatcttgaataggggctgggtaaaataaggctgagacctgctgggctgcattcccaggagattaaggaggttaaggcattctaagtcacaggatgagacaggaggttagcacaagatacaggtcataaagacgctgctcataaaacaggttgcagtaaacaagctgccccaaacccaccaaaaccaagatggcgatgagagtgacctctggtcatcctcaccactacactcccaccagtgctatgacagtttacaaatgccatggcaacatccagaagttaccctatatggtctaaaaagaggagaaaccctcagctctgggaattgcccacacctttcctgggagactcatgaataatccccaccttatttagcatataatcaagaaataaacataaaaatgggcaaccagcgcaccatgccactgctctgcctatggattagtcattttttattcctttactttcttaataaacttgctttcactttatggatttgcctcaaattctttcttgcaccagatccaagaacccttttttggggtttggactgggacccctttcgggtaacatttgtgtccccagcccaaactcatctgtggaagccccaaccctcaatgtgaggatggcataggaggtggggccttggggagataattaggtcatcaaggtggagccctcactgatgggattagggccactgtaaaatggactccagagagctgcctcaccccttccatcacatgaggttgcaaccacaagactgcactctacagcccagaagaggaccctcaccagaccccagccctgctgacaccttcatcttgaactttcagcctccagactgtgatcaaaaattctattgtctacaaattgctcagtctctggtgttttgtcatagcagcttgaagtgactgagacaaatgtcctcacttgaggatgaggcatcagcattatcatggaaggactaccaatgatcatggtgactttttttcttctttatttctttaaactgacaaaaattgtatatatggtgtacaaggtactgttttgaaatatgtattgtgttgggaatatggattggggaatggctaaatcaagctaattaacatagacattacctcacatatttatttgtggtgagaacacctaaaatctactctcttagcaattttcatgtactacattgctgtgaattatagtcattgtgttgtacattagatgtcttgaactgactcctcctgtgtcagcgtgccctagccccctcctgtgccctttagtcagcgtctctggcccccagatcctggtgaccatcattccactctctgctttatgatatcaacctctttagattccgcatagaagtgagattatgcagtgtttgtctttccatatctggctaatttcacttaacgtaatgttctcatttcacccctgttgtcacaaatgagggaatttcattatgttttaaggccggaatagtatttcattgtacatatgtaccatattttctttactcattcatccgacaatggatacttaggttaactccatgtcttggttattgtaaatggtgctgcagtgaacatggtgcagatctctcttctggatacggatttcatttcctttagatatatccccagcagtggggttgctatatcgtttgggaattctattttgaatttaataatgttttccataataactgtactatcacggtgattttgaagatcaatatatctccacagggtagacagctacaccatcattaaaaaaagagaacagtggccgggcgtggtggctcatgcctgtaatcccagcactttgggaggccaaggcgggcagatcacaaggtcagggattcgagaccagcccggccaacatggtgaaaccccatctctactaaagatacaaaaaattagccaggcatggtgacgcagcgcctgtactcccagctacttgggaggctgaggcaggagaatcgcttgaacccaggaggcagaggttgcagtgagccgagatcgcaccattgcactccagcctgggggacagggtgagactccatctaaaaaaaaaagagaacagtgaaaatgagagacaaaagtagctgattcccagcttcaattttgtctataatactaattttcatgaagagcaacataaactccttggagtgcagttaagtccatatctggagtcaaaaaaacaaaaattcaaaacaaaacaaaacacccatgataggtctgaaataactttttgctgtcagaaagcaaagatgagccgggtgccagtggctcacacctgtaatcccagcactttgggaggccgaggttagagttcaaggccatcctgggcaatatagggagaacctgcctacaaaacaaaacaaaacaaaaacaaaaacaaacaaacaaaaaaaaccaaaaacacgcacacacacacaaaacaaaaaaccaattaggcgctgtggtactcacctgtagtaccagctacttgggaggctgaggcgggaggattgcttgagccaggagttttgaagccacagtgagcctgattaggcggcagagctagaccccgtctcagcaaaacaaaaacaaaacaaaaacaaaagcaaaggtgcttccaacaatcagggtgatcctaaaatgacagagcagcgttttgaaaatacctccccggggctgcaatgtgaccatttgagcactaaaaacaaccatacaaatggttaattagaacatgccccatttataaaaggaggaaagttaacatacacgtttctaataagacaacaaaaggatggaaataacattgtgttgaatttttgttgattttgttaaaaaggagcgcgttgacacatagggggattttgtttctttaagttcatgtctgtttatataaagtttaggtctgggtgtgtgtgtgtacctgtgtaagcaggaaagagtaaacaaaatcgagagcccgggacaaatgcacttaagaaggggcgacgggagggccaggctcgccgggctgagtgctgaggagggggcgcgtcccacccatgcaagcccggaacaaaggcgcctgtcactcgtcactctccacgcgggctggctctggaaagcccaaaggaaaaaaccctcactttcaggaagaataagcctcagcccatgtatctagggaacacgtgatgctgcaagaaaccagtgacttaacgcgtgtaaaagcaggagagcgtcagaggttctgaccccgggggaggagcagacccgcggcagcgtgcggagacttagcgggcggaatctgccaccaacgcaacctggcccagaggttttgaactgaccaactgggagacgtccccgagcttgaataagggcctcaaaagcttagcgttttatgcagagtcgcaaccacccagcgctgggaacctgagcctgcacaacccactagaaagcacccgtgaccgtcccctgcgcccgttatccctgcgccccgcacccctgtatccccggcttctctgcagctgtacaccctgcactgcggcgccccccagtcccgctgtccgctccatcgcgcaggtctccaaaacgaatcccggcttggaggggctcagcggccctgggcctgtgcgccgttgcggccgggagggtcattttcatgcctaaggacccgccccttgcacgcaacctcgggtagccagccggaaacggcgtcccgggctccaaaggacatctctttttacatttcagcaaaacagccgcacaccttctccccagatggcctctgtgcagcctgaaaatgcccgctccctccaagtccctgggcaattgctgggacgcatctcagagactgcgcggggcggagaaggggtatgtgtttgggccactaatttgattttcttggaaactttcttccagtccaaaccggagtcagctcctctcacccttgtagaaaagcatcccgtgggggcggggcggggtgggttggggcccagcgttggggggttgggggggcggtcaacacaccaccctcccgccctttgttaagctattgaagttcaatttcattccttctccgtcttccattgaccagagaggaaaggaatcctttgaattttttttttaagttcatcaaatatccatttagcatctactatgtgccaggcatagctgttagtacttggggtgaacgcatcagatgaaaacatgcctccctggagcttgcaatttagtggaggaggaggtgagagtaaacgtgaggtgatggcacggtgttggaggggtgttcactataggcagagggcgccaggaggccggtggtcgcgtaggacagggaaggctgcagttggagagcaaacctggaggagcagccgcggtaaggcccagagtgcgaagacgccgcgtctaagggcagcagaggggacctggaactggagggttggaagaagggtggtcacaggcaagcagaagggggcctcagaaagactggaccttgttttgagtttttggaggaacctccgtcctattttccgtgatggctgcaccagtttacattcccctcaacagcgtgcgaagggtcccttttctccacatcgtgaccaacacttgttgtctcttgtctttttgatattagccattctaacaggtgttcggagacatttcattctgattctgatttgcattttcctgaattttatttatttatttattttttgcgacagggtctccctctgtggcccaggctggagtgcagtggtgcaatctcggctcactgcaacctagacttcccgggctcgagggatactcccgcctcagcctctggactagatgggacctcaggaacgaccacgccccgctgatttttaaaaattttttgtacagacggagtcttcctatgttgcccaggctggtctccaaagcctgggctctagcaatcctcccaccttaggctctgggattagaggcatgagccaccctaccgaccctcctagattagtaatgttgaacacctattcatatgcctgttggccatatgtatgccttcttgggagaaatgcctatttaggtcctttgtctatttttaaagttaggttatttggttcttgttttggttttgttttttgctaataagttgtaggagctcttatatattttgggtattaaccccttaccagatgtttggtttgcaaatgttttcacccatccataggttgccttttaattttgttgatccagccatctcacttctgagtatgcccaatggaaataaaatcactgtcataaagagatacttgcactcccatgttaattacagcactattcataatagctgagatacagaaacaacctaaatgtccatcagtgaatgaataaagaaaacgtggtatagatattagtgttacatgctatactacactataataatgaaaattattcaggtctaaaaaagaaggaaaccatgtcaacaacatggatgaacccagaggacattatgctaagtgaaataagccaggcacagaaagacaaataatactgcatgagccaacttatatatggaatctaaaaaagtcaggggctgggtgaggaggagtacaaagcttcagctataagataagtagttctggagacctgaagcacagcatggagactctggttaataacatatcatggacataaaatttactgagtagatcttacatgttgtcaccgcacacacagacacatgcacacacacacaggtaaccacatgaggtgatgtgtgtgttaattgatttgactgtggtaatcatttcaccacgtgacatgtaccaagacatcatgctgtgcaccttgaatatgtacgagctttatttgtagatcatactgtcagaggcatttgagttagagcaactccatcttgaataggggctgggtaaaataaggctgagacctgctggactgcattcccaggaggttaggcattctaagttacaggatgagataggaggtcggcacaagatataggtcacaaagaccttgctaatgaaacagcacgcggtaaagaaggcagccaaatcccaccaaaaccaagatggcgactaatgtgacctctggtcgtcctcactgctcattataatacattaattatcattaattataagtaaaagatactcccaacagcatcatgacaatttacaaatgccatggaaacatcaggaagttaccctatatggtctataaagggaaggaaccctcaggtccaagaattgctcacccctttcctgggaaacgcatgaataattcaccccttgtttagcatataatcaagaaatgaccataaaagtggccaaccagtagccctcagagctgctctgcctatggagtagccattcttttatcccttcactttcttccttttttttttaatggtgaaaatatatgcatatatttagaattagccagctggactcagtttagatgatcccaattttgttggtaacatccaaagcactgtaatcaggagccagttgaacatatgctctccatcaggctgatcagggtgttgaccttggccacattaatgtcacagagcttcttcacagcctgtttgatctggtgcttcttggctttaacatccacagtgatcacaagtgtgttgctgtcttctatcttcttcatggcagactcagtggttagtggaaacttgatgatagcacagtggtcaagcttgttggggacaatttgcccaggatatttgggctgcctccggagtcacagtgtcttgggccaccagaaggtgggtgacatgcggatcttctttttttgtgtgtggctatggacacctttcaacactgccttcttggccttcaaagcctttgctttggcttcggctttaggaagggcaggagtttccttcttcgctttcagtgccatcttgtgaaaagctcctttactttcttaataaacttgctttcactttatggatttgccctgaattctttcttgtatgagatccaagaaccctctcttggggtctggatcgagacccctttccggtaacagtacctcaataaagctgggaaaaaataaaaagggaccagtaaagcattctcaacaacaaagagcgtggggcttttctttgtagggccctgtgaggcctctgggggttttccaagaagcaagggctttgagactgtgtgggtaaagctcctggggctggaaatgtgatagttttataactgtgatgatagggccaggcacaatggctcatgcctgtaattgggaggccaaggcgggaggaatgcatgagcacaggtgttggagaccagcctgggcaatatggtgaaaccactgtctctacaaaatacaaaaaactacccaggtttggggagcctgcctgtagtcccagctactcaggaggctgaggtgggaggattgcttgaggttgagacagcagtgagctgt

SEQ ID NO: 396 - DNA, 8000 bp, Homo sapiens
  Locus number 8 genomic DNA region, tetratricopeptide repeat protein 15 (TPR repeat protein 15)
gcagttattaggagcagcagcatattataatttttgggaaaactaagattcttcttgtcagattcctcctttcacttcctaactgttgtggtagaagttttgcggagttccaagatgatggtgttaacagtgttcctagtaaggaaggaaggggccctctttatccttatctgtggagaaaaaacaggcgtttctaggccccttgttgtcctgggctttgtacccacttccatttttttattaccataacttaaaagataaaaagaaaaattgtttgctttctgtactatatcagttgatggagaatcatgttaccaacttttttacatttcaacacttttcttgaatcttaaaacggggtttaattttatttacagaaatcggaagcacataacttgaaattgagaagttctaaatcagtgactttctaaactatacgaatttttcattatcctccatgtcacattgtaggaaatctttatagtatttgagagagaaaattctgggccatagggtgatttgtggatggaaaagccaagttagttgaagtagttttgcaagtcagctttcctggtcctgttatgtcctatttcagaattatgctccttaaatgcatactacaggctgggtacaggggctcatgcctgtaatcccagctacttgggaggctgaggcatgagaatcgcttgaacccaggaggctgaggttgcagtaagccgagatcaagccactgcactccagtctgggcaacagagcaagactctgtctcaaaaaaaaagaaaaactgcatactacagtgtaacgatgagaggagccacttagcactagctatgaagcagcagggacggtggagcagagagcaggagcttcccacaccgctgctctgggcacctgcacttactccacctgacagacacctttgttgcattcattatgaggcagccactgctctgagttccaatattaactcatttaatccttatcacaaccctatgaaggagatgttattatcccaatttacagatggggaaactgaggcacagataggttaggtaacttaggatcacatgagttgaacccaagtcatctggctctaaagtccatgctcttcatcacttgcctggcttcatcactataacatgtcccgtttgaagacagaaggaccgagagtcctctcttccaccctgcaccagcatttctgctccaagaaaggacagtgctgtccggggtcaactgacatctgctcagaagacccctgtgctgaatggggccctgccccttccccctgactgatgcctggagatgggctcgagcctgtgctctgctgggctgggccctcctgagactcttgagggggcttccaagcaacagcagttgacagctaagcatcgtagggttggggagaaacgagaagggttagtgcagtcacatcctaggaacgtttctctcaggctgactgggcgtggggccaccgtcagtgagagagccactcatgcttctcgttccctccgctggtctacagttccacctgcctctcatcttgtgaatacataaccgcacttcaggtatctctcatgtttaaagatacatatcttttccatggcatgatccaaatctaagccaacactccttatggtacttaaatgaggaaatcgcaattcgttctaatcctggaagaaaaacaagcagttggatttatgaaaaggtgtgtgttggtcttcaccttaaaggattttcaccgttaatttcaatatgtaattactatgtgttcctttatgtgctgacttaaaatttgacaccctcttgagagagagagctgcactgtggcacagctggtggatgcctggaccaagagggaaagacccagggcatgaccatatagtcagccttgcctgtccgccacctttggcaggagaagaagcaccgtcgccaacttcctcgctcacttccttgcacgttaggggctcatggccgcatgtgggcattcttgacctttctgcggctggttcagtgttgaactgaagcagtttttatctggatgtgaacagtgggcactgcggggacatggagcaatgcgtctccacgctgtccagaacagctctatctgagcttgttcatttgttcatgcagcaaatgccctttcagcacctactgagtactgcacactggcagttcgggactcaacagaacgcagcctcgccctcagtgagtttacagtttggtagacgatgcttgtttcacctgttccttttaggtttgcagccatcaccaatacatcatgatcctccagaatttaaaaagggacagtttgtgttcatgctagaatttctttactcaagaagtgtgtattagtccatctggctttgccataaaggaatacccgagggtgagtcatttataaagaaaaggtttattttggctcacagtcctgcaggctgtacaagaagcacagtgtcagcatctgcttccagtgaggcctcaggaagctttttttttttttcttgaagcggagtctcgttctgtcacccaggctggagtgcagtggcgctattggctcactgcaacctccacctcccaggttcaagcgattctcctgccttgcctcctgagtagctaggattacaggcgcccatcaccacacctggctaatttttctatttttagtagagacagggcttcaccatggtggccaggctagcctcaaactcctgacctcaaatgatccacccgccttggcctcccacagtactgggattacaggcatgagccactgcgcctggccaggaagcttttaatcatagtagaaagcaaaggggaagcaagtgtgtcacatggtgagaaagacagcgagagagaagaggaggaggagggaggcaccagactttttttgacaatcagatcccaaggtaactaacagagccagaactcattcattgccatagggacggtaccaagccacccatgagggatccacccccaggacacaaacaccccccaccaggccccacctccaacactggagctcacatttcaacatgagatttggaggggatgaatgtccaaactatatcatagtgcaaaatctaaaaatactaaaagccagcccaccactattctgccggtgttgatttgctggattaaagtgaacggcttggtgtggcctttgatcccctctgctctccactggtgagtaaagagagaggtcagaccagagactccagggttctccagcatgacattctgattttcccagaccttcacaactccaggaaatcctcaggaagtcttaaactaaggatgtgttagtgagacctctcggtccgtggactgccctttgctgcattgtttaaagtattcaccacacctgccccaaaccacacgcacacacacagctctgctcaggacacgtgctgtgtgtcccagcactgaggtgcagtcacgtgttaacgctgcatggatgtgtgaggtgctgaatgcattatgttgattaccccctactaatgcccacagcagctgcaagtgattttattatcctcggttcccagatgaggaaagtggcctcagggaggtgaagtgttccccagacaactgcagtgaggcagcgatggagcctggctgagccccatcacacagctccagaagcctcacccttgagcaccactctgcggttctctgtgaaattagaccatcaggattgtggttttttcctccaaatacagacttttctctgatgctttgtaaagcaggggctctaaagtttggtcttaagcgtcacttgaacagttccagaaattttagcaatctctactgcacttgctcctgccaaaaattgctctcagtagattcagggaactgtggactcttccagtgggtgaggagagtcaaacagagtgaaaagaaatgagtccagaatgttaaacatgatttcctttggtgccgttttccattagctcctcctcccgcagggcgtggagagcagccggttactcgagggtagggcgtctagagcagccggttacgcgagggtagggcgtggagagcagccggttacgcgagggtagggcgtggagagcagccggttacgcgagggtagggcgtggagagcagccggttacgcgagggtagggcgtggagagcagccggttacgcggttacacgagggcggagggcgtgtgccgggagcacaatccgggccgaggctcctggtaagggagcagagcgggaagctgatcccccacggattcttagggggccgacttcccctgtgttgaagattcatcaaagactgattcgagtctgtgttcagcatgtgtgttttagattagaacagtgttgagaatttttatatggggcccagttttagcaggacatcatttaggatctttacaaacgagttcagggtacttcgttttatctgttgtctttgagccactgagtgaattagtaaatgtttgcaaatgtgattgcatcagtgaagaagaacatataccacgagttaaaataaatttcccgtgctgctgaaaaatcagtgccgccatcctctgaccctgctcctcccacgcgccctgcaggctgtctccctctggggtcgagagagcttcacagaccatttgggaaagagccaagcaaacacacttctgcaagccatttgcataagtagacataatccatacggaatgatgcactgttcggttgtagtttcattcgtcagtgacctgcatctgcccgcccagtcttgagttcagctccatccctccctgcagttccgcagcctccggcttccccacctcagcttggctgagagtttcacgttcatccaagtgcttctttacagactcactcccagctggaggaggcagagggtaaggtacattttcgtgcactccggaaaagaaacgtattcaacaatgtccatgtagcttttgcttctctattgataattgctaatgtggtagtgagagctttgtttgtaggaagagttaatatcttttctaaaagggttttttgacagatggacattcttcagttttgctgtcttatttgttaagcaaagttagaaacataagtgagaacaggcgtggctggcctctaacactgtcagggccaggactcagggcctggccacccgcacaccgacagtggccagttattgccatcaccgtgcctgacccagagggtttggttgcccttcttttctgctgcttccacagaaaacaaattgattgtggcttaatcagatgagatgggaatgactggcaggtggggagaagaaaggaaaggccgagtgaggatggccatccatcgaggccacttccctgctctttgccattgaagcccatgctcctggaaccccgtgtgtgttcagaatgtgcaagcagaagaagaagagggagcggaaagcactgggcatcagggctttccaggggaatgtcttgacctggctggcagtggaaattcacaccttcagaaacctctagagttcatcgtggccaatcctgggacatggacttaggaatgcccaaccccgccacccagccgtggcaacccgattcaaaaccaaatgcaccaaatgtgaactcgaaggccatagcccttgccagcgacccagccctgaagcgggcatgatagcccagagaagaggcctttgatgtaagatgattcttaaatcgtgcattctttgccttgcttttctcggcagtatgtgttctgtcaatctgtgatctgagtagaaagaagaaagtgtattttcaaggtatgaggggcccagaggacactgtcccaaaagcagtggttgtgagagtggctttggagtcaggctgacagtctggaaacttccaggtccgctctgaagtgccggctgcatgaccagccctccagcctgtgtccgcttcggccttctttgtgcaagtgagagcattgctgatccccccggggtggcgagggggcgcacgtcagtgacctcgcatggtgcctgccaggcacgtggtccgtgtttcatgattctttgagagctttggagcagctccaagaagactcttttactttgaagaggtcccctgggaagctgtggtgggactggaaggtcgcaggactttccaaaatctaagtctctccagaacagagctgctccaagctttagtctccactcaaaagggtccacttagtaagttctcaggtccttggcttagtgccagcttcccagtagtttgtatactagatgccttgggaataaaaccagttccctaaacctatcccgtgctcacccacgacccgtgacagctgccaaagggacagacgcaaaggctccttcctcaaggccccctgcagacagcactttccacactgaaggtgtcagtgacccagccagaaaacctgcttcaccacctcctggataactgcataggatgagaacatagatttgggtctctttaaatatgaataggttacaaattgcctttttaaatattgcttgagatcaagtggtagtggttatatatggagtcaagcagctgggatattcattcaaggcgtgtaattttcttcattctttggacaaaacacaagcaggtttttaattttgaataattgatcttccctcccatactgtgggcaggtgttgatggttccccaccttgttagcctgaagcctgttcatccctggaccggccatgacatgcccagtgcagtatcccccacggtggggctggcagcagcccctccacactatgcacagagcagtctgagtctggaatcgtctcttcagccttacagctgttccatctgttattttctccaaactcctcttccctgcatttccaagcagcgtcttctcatgattacagtcactttcagagatgagctcatgctgatacccaatgaagaacccagttcagaattttctttttttttcttttttgtttttttgagacagggggtcttattctgtcacccagactggagtacagtggcatgaacgtggctcactgcagccttgacctccccggttcaagcaattcttctgcctcgccctcctgagtagctgggactacaggcatgcaccaccaagcctggctaatttttaaactttttgtagagatagggtctcactctgttgcccaggctggtcttgaactcctggactcaagcagttctcccacctcagcttcccaaagtgctacagctgactataagcgtgagccaccatgtccagcccagaattttcaaattaaacaaaactaaccctccaacatgtttcagtacagtggcctcaatacactattcctcatgcaaagccttcagttgaaagtgctgggtaacttggatttgcctgtgtgttgaccatcagttgctgcctaacagattatctgcagctctgtgggctaaaaccacagggatgtatgaccttcctatttctgtgggtctcgagtccagcacagcttctgggtcgcactggctcaggtctgtcctgaggttgcagttaagatggtgaccgcagtgtctcacctgagggctcagctggggctggagaactgggctccgggaggctccgtcatacacccgctgagttctgctgctgttggtgagaggctgggttcctggcctcatggttctttctgtagggcttcttgtgcgtctcacagcatagcagctggctccctgcagagagggagggaggaggaggaagccacagtgccttgcacggccgggtctcagaggtctctatgtcccctccacctggttctttttgtcagacgagtcactaagtccaggccacacgcaagggatgggaatgagactctgccttttgaggagtgctcaggaatgcatggccgcatttaaactgccacactgtggccggtcagctgggtctgttccacttcaggatccacaggcctctcctggccctgcaggacaggctcccctgcctccactccagcccgtcctggtggttgtgagccgcacttaaccctgccaggatgcggcttgtactgggaggccca

SEQ ID NO: 397 - DNA, 8000 bp, Homo sapiens
  Locus number 9 genomic DNA region, Feature name CHR02P042255672, Ensembl gene ID ENSG00000162878
agggagatgggtgggcgtcgtagagcaggagagactggcccaaaagttgtttatactcctgttggctcccagtctccccctcccccatcgtattccccaaccctggtcagacacttgtgaccgggccctgggccccaaactggtctcaggagctcgggcagaaccaacacttgcgtgtagtgaagcctggctgcacagctcacaccgtgtctgcagcttcagggagtgagcccctggttacgtggccattctaactgggaggatcttgtactctttccttcccagggacttttgggaactttttggaaactctagggtgtcagccagatcctgagggagtggagaggtcttgagtgacttagcaggacataaagtcttagttacttgactcaagacccctctcccttcagacgggtttgatgtttgatgtgctttcctatcttttaagaaacttgtccctcactcttcccgccagctcaaacttcctgacaagcattcagctaacgccccacatatatatcacgtgacggtcctcctctgaaatgtcaggcccccagcccaattctgaaggcaccaaagaaaaaattacaacagaatagttttcacccttccctcaccaaaccaagaccagggttgtctggggttagctgtgtgactctttattgtagagtcccagacgagagttagtggccccagggcacaagggttgctaagggagagagggtcacaggtcctttctacccaggaaaagtgaaaagtggggggccctttagtgtgagtttagggactgctttgatggtggctctcccccattcatcttctgaccatcaggccagtgtcgctctggcctcctaaacacggccatctttgctggcagggaagcctacagtggggtcttcctgcccaggaggcttcagggcaggtgtacagggaactagaaataatgctgctttaatacctctgagttatttaaaatttcaaaaccatttgactgtttgctgaactggggaggagttagagaacatttctagagttcctagtggtgcaggctcaccaccctccctctctgagcagcccagaattggtgctgtggattctaatagaaaatgcccaggctagcaggccccattctgcacctcccagggctttctctggtcatggggattgcctgggcgagatctttctatccattttctttgacccctccccatcccgcccctgacacacgcatacacactccctcacgtgacttgactcctctatagcccagggccaaagggcacaagggtctcccctcccctcaacctctccccacctccccctcccccagtcatcctggggcccccaggccttggatgggcccccaggcctgcctgggcccagattctggccctgctagagtatatttcttctcccaaccaaacaaaagatgtgactgaaatgctcagcctcacgcttcctggggggggttaatggtgtctttttattttttcctgaggggtgttgattaatacctcgttaacagcgcatttaacgacctccgggtgtttaataaccttcagaagtttcccacaaaggctcagactctgggcaagaaaatgagaaccaggccccagggctgttccccttaccttccccccaccccaccagggtctggggcttccctggactgatggggagggggtggagagagaagagggtgcctggagctgccctggccccccaagtcacagcccaagagtgaggccttcccccatgccagcaggatgacggggagctgagggggcactcctagggcgggaagaggacatgtgaggacctggagtggctctggggagggtgtgaatgatggtatgagggtgacagtgcacagggatatccacccctccaccgcatagctctcctctccctgagtcgggcctggacaactcagccttcgtgtttctaccccacagggtgctggttgttttgagcaccatacgagcccctagctgctgtggagtatgttggaagagccagggggatgcctgtgggtgctgttaaggtggtagtgacactcaggctttgcttcccagaagtccctgggcagtgcggagcttctccccagatgacatagagtgggcagttccctgtgaccgtaaccccaaaagaactgatcttccaggaggaatcatcactcactaccacccccactgatacacatcactcatatgcaaaacacacctggggatgtgccctcaggtaccttgttcttatcaacacttgttaccagtctaagggaacttgcttttcctccctcaagacccacgcagagaaaattgaagctgccagaaggtagaaatgatgagggatagatacagattcaaggaggggaggaaggataatgtccaaccgtatgctcgcttgtgtattaccaaacagcattcttagaaaaaacagattgtggccgggcgcagtggctcacgcctgtaatcccaacattttgggaggccaaggtaggcagatcacttgaggtcggcagtttgagaccagcctggccaacatggtgaaaccctgtttctactaaaaagacaaaaattagctgggcatagtggcaagcgcctgtaatcccagctactcgggaggctgaggcaggagaatcgcccgcacccaggaagcagagtgagctgagatcatgccactgcactccagcctgggcaacagagcgaggctgtctcaaaaaaaaaaaaagaaaagaaaagaaaaataaataaaaataggttgtggaatccgagtggcacaaattcacatcttaggctcctacattgatcagctgtgcgaccttatgcaagcaacttaacctctctgagtcagcctcctcacctgaagttggagataataatagcacctactgtgcccattagggttattacaataattgagttatgcacgtagagcaatttagcatggtacctggcacgtggttaactcacagtggccagacctgcctatttacctgagtcggaaggggtgaggggctgacatggtcagtaggaagtctgactgcagggaagagagggcatgcttcccaggcaacgctgccattctcttctggcctgagctgaagcaaaggcctggggatggtgggaggagagagagggggaacctgacagtccagcccttccctgtccccacccccaccctgtgacctaatgacctgccctcggctttccccagctctatggctactgctaccaggacagcgaggacatcccagacaccctgaccaccatcacggagctgggcgcccctgtagaaatgatccagctgctgcaaacttcctgggaggatcgattccgagtgagctcagaggagggctcgggccctgggctccttgctaggatggttctgccttagaaggccagccctccaaagcagctcccactcctcctccacccagggagagggaggggaggaaggcgcacaggctgactcagccaccggccaaagggttcaaaaaagaagcaagacttaaaggatcccgacatgctgtgctcttgccctcctcacccctccttgtgcgcgtgtacacaccagcttgtgggggctggcaccttaaagaggggagcactcacacactcacactcagcctgactgcaggagggccagtgtcctagaactaggaaagaccttaataccatcctgaccctcccgatatttccatacactgaactaaaacaacattcaggatgcaacttcagggaagagatgcattatccccagaccctcgctgctgcagtttcccacccactccatatcatttccagggtcaggccagccgagagttaatagaaaatcactggcctcctctctaaggctgctgaccttggcctttgtggagccctggggcctatagaagagaagtgccaacccccacaagcaaagttcagattccaagaggagggtgccctcgagtcccacagacccccaacccaggagaaaagcagtgagcagtcttttcttgtgcccctcagatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtgacctccacccctgactcgggaactccatcgaaggagaatgggccaggagggcatggcaggaagagagccaacgtggaggccagctgggcagggagactcagccttgaccagagcaagggaaggcttctaccctgtccagaagggaacattcaggcctctgatggagaggctaaaaatagacagctccaaggagaatccgggttagggggtggcagctggaggcttcttaaaatagtgttggactcggagcctagggctggtggaactggcacttttcccttcccacccaggcccttgtgctctgggaaattcctcactgggccccagccatggggctgctccgacaccgggagtcagtcaggggataatgtggggctgggaggtgggcaagtcctgggaagggttgggaagcaggcccctggtttcggttagtatgaagttaggtgtggtgttagcatgtgcccagaaccctcccccgaggctgagtagacttcactgcgttctgcctggttgctaggcctgagggatccggctccctggccaggttagcgttctgccccaggttggaatagaggaaggatgtgtctccaaaggctggattcctgagccactggtttccctctgccacaggtttttcttcacatacctcctgcctcacagtgccccgccttcactgcgtcctctgctggacagcatcgtcaacgccacaggtgagctctccagggcccatctgcttccaggcacctaccccacccccacccgccagcaaaagtggggagaaaaataacccagggcagcaggggttctagaaaccatcacttcctaaggtggcattctgccgcaacctccccgctcccccgccctctgttcactggggcacaggctctggaggcagaggtgggagcagctggctgctgacttcagggaggagtgggagccccaggcatcctgtcttagccacactgcactctgcaggagagctcgcctggggggtggacgagaccctggcccagctggagaaggtgctgcacctgtaccggagcgggcagtatctgcagaactccacggcaagcagcagtaccggtgagtggccccaagctgatccacagggaagcaagaaacaggtgggagggtgaatgaccccgcccaattaggctaagtggctcaccctttctctggggacccttgtctccaaaggccactgtaggggctcacatagaatcatggaggggctgacatggactaatttgaggttccatctctagctgagctagagcaactataattctgccttcaacctggggttgggcactgatacccctactctggatggctccaaaccctatcatgtactggctatatgactttgagcaagttaccccttgaacctcactttcctcatctgtgaattgggttcactattacccacctcaccaaattcttatgggaattaaatgtcaggtgaaatgtgtgaaagcaattagtgcagttcctatgacacagctggaacgcagtatatgtttgcttccctttccttcctctaacctcccggggctagaagggcactgcatgttagggaaggcacacactgaaaccagccaagaagccccagggcagggggagaattctggccactggtttcaggctgtggtccttctgctgaagccctggggtttagctggggttggcaggggttgaggggtgagcaggtttcatattcaaggagttctggctagtcttaggggtgggggagccctgttagccctgtaaataaagtttaacgaggtgaacaatggctggctctgtccctgaggatgctgtttatggggctgtaaatcacagtcagccctggactttggtctagtccctggtagaaggaggcaggagggtggggtggccagaggcccagggcttctgcattatcagtccagagctggggctctccaggcagtgggaaagacaggagcaaacaagaggccagcagctgaggagctcactgattgtgagttttcagagcttctgaggctctctctgtagaatgagatctcagattttccctccagccccctccccactctagccatggattttttgcattttagtccatttgcatgcctcttaacttcaaaaaccccgactcccttccatcccaggcccttctgaggaacttgcctaacttctctccccaaggccaggagaaaatgtgaatgagggttgctctgaacccttgcaggccacactggatgctggttagaagtacagattctcagttctaccccagacctacagaatcagaatcttcatttggttgggcatggtggcttacacctgtaatcccagcacttcgggaggctgagatgggaggatcccttgagcccaggatttcaaggctgtagtaagctatgattgtgtcactgcactctagtctaggcaacagagtgagaccccatcaaaaaaaaaaagaaaaaaaaagaaaagaaaaagaatctgcattttaacaagagtccttggtaattcacatgcacattgaagtttgagaagcctggctccaactgtctaaaatgtcctggcctcagcaattagcctagacagctgggactccatgtgtccctgtatatgtctgtacccctttcatgtgcctgctatcttgtactgcctgaccaagctatgtgcccttagatttgggaaatatgtatctcctgaaaatcaagtctgtgctttgtctttattgagcagtcagccctgtttcaacagtggtagctgccttcatctgcgtgctagagggctgggctggacttcagctttcacctaggaaatgagtcttgctgccctttccagaaagtgacacatccttgggcactcaaacctgggcatacagaattctcattttactccatccccaacccacagagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtgagccagtgggagaagcccttccaagggagatggcaggacctctctggaggttgatagatagtgatcccccatcggaagtcagagggggtgctgaggtgatgagagagaggtatacgtgtcttcaaggcagtcaaattagggagaatggtcttgcctccagaaagagaaacatccagccctgttacctctcacctctgccccccaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagcccca

SEQ ID NO: 398 - DNA, 8000 bp, Homo sapiens
  Locus number 10 genomic DNA region, paired box protein Pax-3 (HUP2)
ctttttgcgtttgtacccttaaagtttgaggatggcttgcggcaggtgaaggggaagcaagctgcacttctgtctcccatgggggagattttttttcttagtgccgacagtgcacagccgaaaaggaatggggatctgtacccctagaagacagagggtgccagcactctaagaacccagatcccttcaatttgtaacccagagcttgggttcctttcaattcccaggcacacacaggttaaaccccctcacatttgaaaatcaacttcaaacaaatcaaaccagtcaacacacagacatatttataaggcagccaatgtgggggcaattttggagggccgttgcccaaaagagtactctctctctctctcctttaatgcgaggaaactccggagaccagggcctttcctgagggcataaaagctacttcaacttctgaagattcaagtaccctctatccccggccctacaattgctcagagatgcccagtctcatacatttaatggcaacagagtgagagcttcccctgccccctacaacagagcacaattcacagttctagaatcccaggggctgaaagtggttaagaaagaaagatttacaaaacagaaaaactaagcagaatagaaatgtttgttttgattcctagtgtccctctggtctttcagttccatgtcgttactcaggcgcagagacaccgcgcatgaagggaccttgatccgagctgggcttggctgccgtcagatcaccaatgtcagctagccgatgccctccaagtcacccagcaagtgcgccgcccaaggcgccaccgcttacctcgctcgctcaggatgccgtcgatgctgtgtttggccttcttctcgctttcctctgcctccttcctctccaagtcggcctcctcctcttcacctttcccgaatttacttctcaggatgcggctgatggaactcactgggggcgggaggaggaaggaagcaagggagcgcacatggttgagacaagcagggctgtgcgggaaggaccccccacccccaaacaccagccagggccctagagccgctgccctgcactgctcgcgggtgtctcctcctgcatctctggacatcctcatccttctccagccctctcatcctgccactcaaacccccctccctattatctgtatctcggtactgaaagacggaggctgggaaaaccgtgcctccaagttagggccggatgccatctttgtccctcgattctgggcaggaagcatttcccttcctggactccgaagaccgggctctaggtctgcaatctaagagaattctcccaccagcccaccgggtaccctccttcctccccacctgaatgcatggatcctgcggttcgccttaagggaggaagaaccaaagccgacttgtccgcgcccccccccacccccccgtaaatcaagtttcttttttttcctttcttcccttttttttttttttttaaggctataaagggtttaaatttcaactgcagaatcgtttcctattgtaaaaatcaaaagaaaatgcactctctcccacttattttttccagattccagtctggtaaacaaatccatgctctgaaatatgtttctcacagagggaaaaagggagtttccttttaattaaaaacaaaccctcccgtgcgccctctcgctggccccgtgcttgcccctcttctccctccgcctcccccaggctgccgtggcggggggctccggaccgtccctgagactctcggaggaaatcggggccgttgtggaagcctccacggctttgcgcacacggcaaagtccctcccggcgcgggccccatctcccttcggttggggttaccaaaacatttgtttctctttaaaagggaacatcaatattaataaacgctctgcctccgcctcacgtttcctgccctgcctcctcgacagaaatcttctttggggcgtcctcagcggtggtctcgccaccctccgtccccaggacaagcagctcacccctccctccataaagtgccaagaacaccgggttggcaaatattgcagggcctcgggagaggccacctcccaatagctgagatcgataattggggtgattacgtctgggtcgacgtgccggggtaatagcgactgactgtcgcgcctcggggagaggttaatgggcctagtacctgacggcacggtgtttcgatcacagaccgcgtccttgagtaatttgtctcggatttcccagctgaacatgcccgggttctctcttttgtattcctcaattttcttctccacgtcaggcgttgtcacctgctttaagagaacaggcgggcaggcgttggtacccggtaccctgggccaggtggcggcggccccaccgcctctgggcctgtcgggatgctcctcgctgaatcctctgggacggtccccctttgtgagcaaaaagacctgaactctctgaggcactttagaaaggggcagaccagaacacatcccatcccatcccggagcagcctgggaagcctctaacttccccagacaagccccagacaaccgggataaattcagaagaattataacatcttgatgggggtagggtggggttatactttctcatccctggaaataaggcaactgcttacacagaaccaacatgaaaacgaaactaaaaaagcgatgtttgaaaaaggagctgaaaaatcaagttaaatctgcaacttgtgcttttccaaagggatatttatgctaaagtgaagactgaaatgtaaaggtatgtatttgggtttttaaaacttcgagtcgataacaaatattaattaagagagactgactcttctctctacccccaatatatattttttaaaaagaagaagaaggttccaaagattcttagaaaggctgtgaaagtgtttcagtaggtgggaaggaagaggagggtgtttggaggtcttcggtttaccataaccctcttgattttgcccggtggcaactagaagaaaagacagaccttgtgtaattccctcccactcagccctagctggtgtgactctttctttttaaaaacagaaccaaaaataatttaaggatagcaccaaactgcttatttttttttaatggagtcattggcttattacaaagaaaactgatcaccctagtatttgactcattgaaaacaatttgcactgggggagactgagggcggggtttgggagacaaaccattataaaacctaaagaagttccttacattcgttttggaaaggacggtgccatgggtgggagccgggaagacacttagggaagaaatcggcaacaggtgggcacatagagcttgcctgctttaggtgtttatccattaaaataatttgatgaggattgcaaggcttatgggctttaaaaaacagatgttatttttcctttgcaaaaaggcaagagctttccctaagtgttcatcaagaagtgtccagggcgcgtgcacacgtacacacacacacgcgcgcctttacgcaccttcacaaacctcagaaataactcattggagagccccagatgtcagccgttaccccccgcccggtcttccccaacacaggggaccacagtctgggagccaggagggcaaggcccgcccgctcaccttgggcttgctgccgccgatggcaccaggacgtatggagccagtctcctggtacctgcacaggatcttggagacgcagccgtgggacacgcgcagctggcgcgagatgacgcagggccggatgccgtggtgggccatctccacgatcttgtggcggatgtggttgggcagcggcctgccgttgataaaaacaccgccgagctggttgacgcggccctggccgaggggagtggacactgtgggaaggtgaaaaagagaagcaagggaaaagtcactggaggaaaataaaaagcaaagaacagcagcacgtaatttcgcagtcttctgtcctatcctcatgttacagcaccgacgctgaaactgctcgacatcggactcccagacccagacctcctttcaatcacatttgttcaaattattcagcaatatagcgcatgtaatcttgtgtaaagacagcaaatggggcaaaataattctccccagagaaagcgtcttccccttcgggcccggggagtggcaacttaggagaccctgcagctggtagagagtctagcttgctctagaaacagcctcctggcgaagagaagttcacccaggagctggccttgatgaactctgctcccaccgatccctgtccaattgggatctctccctttctaagggacttgggccagctgatagcccttggggtttctagccaaaagtgcagcagccaagggtcaaagagggtccagaaaggaggcccaagcagcagtgcctgtgtcacctgttacatcttgggacagagaccacagcagcggcagggctgttcctgggcccccagcccccattcttgctctgggtgttacattctactctaggctgggtgtgaagggagtgggtggcgggggcgatgagcatctctgctggggcgccctaacctggaaaaccattgaaaacggctcaggcttgcaagacttcctgcctccccgggattcccagaatcttcaagtggacggaaaggcgattcctaaacaagttatagaaacttctagatgctatttgagatacatagaattctaatttatttaattattctaaaaattccaatcacaatggcgcggcgttagccaccacaactttgcagggcaaaaaaaaaaaaatacttcctgaactaacatatgtttcacaagtgtgggcgcagccgggacaatttcgagacaacttcgagacaatttcgaatggacaaattgcggagaagttgcttctgccgctcagaagccggttcacctccttctccaccgcggcatttccaaaacaacagggacaagtctccccggctcgccgcaggcctgaccgcccagctccgccaggatttgcagagagcagcgcgctccatttgcagaaaggaaatcgagtaggtcctcgcccccgactggtgcttcttggggtgtggggtgcccagggaatgggcttcctggaagcaccaaaggagcctgcggagcctggggatggggtgaggcagccggtcccaggccctgggatccaggcggcgcgctgaggccctcccttaccttccagcgggaacccgctacgcgggtagttctgccccgggcccggccgcatcatcctgggcacagcgccggccagcgtggtcatcctgggggcagcttcgctcggaaattatatccaggtgaaggcgaaacggaaaggcgagtgcggcgcggatgaccctcgggaactatccggagcgtggagagcccctccccaaaacggctggagagagagggagggacgcggggaggggggctgtcggttcctagtccagaggccggagctggaacccgggaaaggggaggacggggaggccccggagtccaggatcccgagcccagggcggaaaagtttggtacgagtctgggcaaatgttccagcgactggggtccctgaaaagggggctcagagagccacggcgagccggggagcctggtgaggctggagcgcggcctgcctgagtctcctcctgtggtgacaccgagtgcggggatccgggctcgggagcatttattagttcttttacccaaagcttggtcaggagccctgagctgcgattggccgacgggtagaccgtcccgggtggcggagacacgcgctgattgggcaacagcgaccactttctcttcccatctctggtggtgccgaggcctctgctggccccgagggggacccgcgctgcgccccttgcccaggagagaaggttggcccggtggaaactgagagagacagccccagggagatggcagttgctgagggcggagaagttcctgtctctctgtctctgtctctctgtctgtgtcactctgtgtgtgtgtgtgtgtgtgtgtgtgtgtgtgtgtgtgtgtgtgtgtgtgtctttctctgatcactctttccttgactttctatttccctctctgtctctttctgtgcctctgtgtgtgtgtctcgctcagcctctattcctcttgtgatttcctgtgtctctctctatgtctcattttttctacctgtaggtctcgctctcatttctcttggcttactgccactggagggggcacaattccaataagaaggcatctggggccccagacatatttagctttccttcctgtggtcagtgccccttggcctaggcttgttaaggggtcctcccgatggggctcctcctgggaggagtccagggtgcgctgatgttcttttgtcttctccgtccgcaagcggggctaatgtgaagcacaggcagccgtcgctaggcccaagcactcgttagttgaaggctgggggtatgggggagggtgcagaaaaaaacctggctcctcttcttggtgtaaaaaccgctctggcaagctgcggttctaaatctctacatatagatccccgatgcgtcgacagagatgtgtctgtatgttaaagttttgcccgggttcagcgtttgttctcaggaatttattatggcattcagactaaactgctggaaaaataaaaggaacgaagtcttggctaggagctgaagtgtccccagcaggatatgacgccaggagtgttgtaaagactgtctgtccttagagaaggtaccattgtgcatagccttttatttataacttggtaagtgccagcgaactcgcctcctttacacccccgagtgccagccccgcgctctgcactgcgctttattcgctcgagcctattcagggactgtcactccggggccgcgaggtattcagggccttaatcaatcaaaaggatgagaatcgggcaggtttttccctttgaaataaaggaaacaatgacttctgggcttcaagttcccccttttccttttatgatttttgaatttttcctgcccctggagggagttctccactcctctctctctgtccccctcccccacctcctttgacagttttgacgtgaactcgggcccccaaccctacttccccattccctaattaaggcaaactcagaaggcaagatgtaggggggtgtggggtatagccgctcagcagtccacaagttggccctttaaaaacccactcaccattggggaaaccaggcaagctttcagcctgcctgatgccagaaggcttggttgaccctcagagccacggagacaggtctcaggagactcccagaaatgtctggacccatgaaggaggcatgtgccttgtttaacctggttttacattaaatgattcaatttttcaaggggaaaattttctcattttctttttaaggcgttggggccaccaaagcctgtgtccgtacgttttaagccacttctcagcgatagcattttgagagctagactttttccaagttttcttcttcccaaaggttaagcagagtcgacagagcactttctggggtcagcggtaattgctgtgtgaaggaggtaccagaagtgtaatttcaagaaggcaaaagtaggctcaactctcagctaaaataaactcttggaccccgcgagcagttaaagaacatctagagctgagtctcatttgtttttgagccggaggcttggtctccaagccctcccagcgtccacccgtctctctcctgccgggagttttctctcctaagagccggcagatgctggagggaagcgcttgctgcaagattccttctcccggtcccgtagattgcagagtccgcgggaccgttgaacggaggtactgccggctgagctgggtcttaagtgcccatgggttcataaactagctgtcacttgctataaacatgtacaaatggaggccacaaggatgtgggggtgctggggacctaaagctccggaatcaggaggcgactcattttctctcctttccggcctctttcttttctgccgagcgctctgaga

SEQ ID NO: 399 - DNA, 8000 bp, Homo sapiens
  Locus number 11 genomic DNA region, Feature name CHR03P027740753
cgcctgtgcaagggaatagaatcagaaaaatcgattttaattgggatgtcctagaacaggcccaggccccagcgggttccccagacacctgggatagggtcggaacacatttaaaagtttgcagtgaacagaatgctggtagatcaagtggtctgaaactatgtaaaatatttttgagttggcaactcttggaacctttccgtcttttcaaaaaaaaaaaaaaaaaaaaaaaaaaaaaaaaaaaaaaaagcttgccccaacatcggtatattccaaattcgcgcgtgcttccgaaggctcatattctcggccctttcagacgctcttaaaatttttctcctagaatgttaaaaactactaatttttaaatgcaccattttgaaaagtaccagagaacaatattaggttattcttgttaaaaatatatattaaaactttaggctaaaagtcccctttgagtgcccctctctcagcacccacccctccctttccccagaagtagccagtgttagcagttggatgtatatcagaactttctcgcgcaccgaacccgagccaggtctggctccagggcagatctaaccacctactccgaccgagcttccgaggccggcgctctagccttcatgcccacctcccggagacgccccgtggagaccctggcgcctaaaactgcgggagcccatctactgcgctcaggtggccagctcttgagccttccctatccgtggctccttgccggcatgcaggcatgcacaagcataccgccgagcaggaggatctaacgaatccagcttgtggacatgccctaatttccatttccgcctcctccaggtctgttcaggtgaggatgatgggagggaaaagcggtgtacagccgtaacattggcaccctgcaagagccgccggggcactgacacagagggacaccgcattggagatgcggtgtctacggagatttattgcgcgcggtgaaacactctaagcaccgcgcggaacaactgggttcagctccctcatcccggaccttccccaggaccacacgtcaccctttatccccgaacccaggggcccctccacgctgcgctcacctgccctgtttcgtaatgatcatctcagtttggtggcggtggaatttgagccacagaggccggttgcacaggtagacgtgggcacggaagccagaacctggaacccccaggccccccagtcctccgcaagatcccgccgctgcggctccagggtacggcccgtagagcggagccccctggctgtactgataggtgcccgggccgccgcccccgccgctgctaccgcccgcgccactgcccgcaccggctcctgggccgaactgcgccctcccgggtgggcacacagccgcggggaagccgccggggggcagcatggagccgtaggggtagcgcgccccgttaggagccgggtacacaggtccgtggggcgccccagccgccgcctggtacgggaagagtgagcagggcgcagccagctccgacccctgaggaccgggggactggaggtagtaccgctcggagctcaggctgtccatggagtagcgcgcagtggccgcagccgcggcggcggcggcggcggcggctgcagcggcggagggcagctcctcctccccgcagggggagcccttgcggccgtccgggggccccggcttggccactgccgcagcgctggcaaatgcgtccccggcgtcggtgtcactaagcatggccgcgggggcccctgcgctggcggctgcgggctccccgctcaccgcctcgcaggagagactgccggaaaacttcttggacgctttgtctaagtccaacttctgaggagagggggccgcgctggggaggtggccagcgctcccgccgctgccgcctcgcgcactctccagcgggtagaagtgcgcgccaggcaggttcactgagctcaccaagagctgctcccctaactgcatgctttgcaaagcgcagacggcagctggctgcttcctctcctccggtggccttattataaaggcaggatgggggagccagcgccctcttccgaggggaaggtaacttccccttcctcccgcgccggggctacccacctgccgactcgcgggccgctactgcgcgtactggcgcgccctgaatccagcgtcctttccggaaggaaagcgccgtgagttggaaagcaggaggtggaaactaacccagaagccctctccttttccttcctcgtacctcttgctcctcaggacccccaccctcctcccaggctcacacgctggaagaaggtgacttagatctttgtccccatccacccactagcccgcgcctttctgccctttttcaattgccaaagcatcggtcaagttgaccacttggaaacttatgggctgtcactagctgctttatatatttgcggccagggaggggcttcccggcctcacagcccggagaccctcctattggctggtggaggtgacactaattcaattaggcatttactaattggatcaagtcgcctgtgactttcttttcctttttttttttttttttttttttttttttttgagactgcgtcccgctgtgataatcaatcctggtgtctgtaatttcgccggaatttagggggacaaagtttggggtctccatagcggtgtccacccttggcgcattagtcatctcagccctccgctggaggaatgagatggctggagcagattttagaggccagagagagaaagactcttcaagctgatagcttgcagggaagcgcccgtcccggaggctggggaaactggggcaagttggagacaggcccaaggaagtctctttcctcgtcggaagctgtaacttcaaagcacaccttcctcttgtcgaaggcaaactccctggccttcaacgcacagaaccactttttgtttgttcccatccttttacccagtgggaaaggtttgtagagaggaaactcgcgctaagcttttgggattccggggacggccagagcacattgccatcctggaggacctaagctctcagcttctaaatcagaagcttggacagggtactggggacaggacaagagtgaaactaagcgagctaacaccaacttcatactcacgccaacacaactgctttcggggagacagtcacttttattccccacaatttaaaatcctttctgctcagttttcctgatcccggattccgtcccttcaccaccatcttcagttaggcctgacaccaagaaacaaagcttccctaacagccccacagttaggattccctgcgcctctgctctgcggcaaatacagaaggtagaataattagtgaaataatcagtttgatattgaattaaactccagctgcttgtttcttcgctgcgtttcctcagatagattcaagagcggggccgtcatattttatcgtttcattattacggaagcggggggcacgtttcgttgcggataaggagaagcctgaatattcgctgttaataagcaattacagacgccgccagtaatcgctccgggagcgcattttccggctgagatgtcgggactctgcttccccaaccgaacgcgatcacacgggaaactcttcgcccacaacagatgagatggccaaaggattgctgagtgcgcacacgcaagtgtagaacagtgcgaagctttccaacccagttttccaaccacagcagcaccaacatcggcatgtctggggtctccgagaacgaggtccttaatgcacttagactctccagggcatttatcacggttttttttttcttttttgatgtgtgtgttcgcgcgctcgcgcgctcgcgtgtgtgtggtggtgaaacccaggagtgcgcgaagattttcagggtcaaggcacagccacaggggagggggcaagttgagactagtgggctggggcggtggccttgtaggtcctgggacagagtggccaggagcagatcgccagaaagctggtactgagcgcgttctgccctgcgcttcctgcgttttgtgtcatcagtatagttagtgtttggcacggctgttttgatcactacattgtccatgccttcctcccctgctttagtgttattttgacccaaggaagtctagaacattgattgttcaagtagtatagctctgtgaatacctcatgactgtcaacgtgaagatcccgtgaggggtacgcgagctcaaggaaagaaagaggccgtgcagcttgggcggcttggacgacgtatctatccctgggctagcgggtcctgattactattcgtaggatcctccacattatcctttacctgagttgcaagatatctaaggcaaaagtagggatgagaaatctccctaatgtgagacctaatctcacgttatttggagctagggtggccaaaggtacatgacagttttgcgctttaacaaagcaagaagcgggcctcggcgtcccttcaaaatgcttttgacgcagccagggaagcgcttcgcgtggcaaagtgccatcgcaggcaacaggcatcgttccgacccactctggcgcgaataacgcgggccagctgtcccccgagccacatcagaaagcgttgattttattccagccccagagcaagcttttgaaagcgcatgagttcagtatgagcaccacctaattattaaatatacacacgatgtatataattagaatttgtattgattcttggggacaggaaattttggttgatatctacccacttccccagtaaatctattatttttcccaaacttcaacacattttacatatggaggagcaaagacaaattcaaagagaataaaaattcagtttctataaaactactctaggacccaggatttttggaacatggaaaatatgtacataatattatattacatattgtattacattacatttgtaagtatatgttacaaattctctttaaaataatgaaaagcactgtttcagctacagatctttttttttctggctgaagataaaaaatctcatttaatggttcctctgtgttaattagctaatcacattattattattattattacatttagaatatactagtctagaatgcctggagagttatagatgagcaagtctgtgatttcctgcttgaaatgggctttccttttgctggctcaatattatagccaggggaagagacataaaaaatattttcacgtgtcccagccacactttaaaatccaggcactcctttccagaagtaggaatagaaaagaaagccaaagcagtggcttaagtgaacatgtcaggcagcaccctccttagactgggtgggcaaataacagagccttccagcctgtttgctgtttgatttcaattacaccccaagcttcatgaaatccaaatgagacatttattgaaaggtgcctggttttatgtggctcaactgacagtgtattggaatacattgaacaaaaacatcaacactggggaggaaacatggaaaccccttgaaaccccagacccaaatacctgctggattaactcaaatcttgtacctttcagcctgagatggagcaagcaggaatctttaaaggctaccaggaagccaaggccaagtctgtgtgtgaacacattaaagatctcacgctctattgttctgaggaataataccaacttcataccactgtcttggtcaaagttattgccaacttgaccagatgacctctttatctctttctcccccttaaaggtaaccactagccatgcattgatcttttaaaagcaaaactgagaagcatttggttggaacaggattattatataagaaatacatttacacacatatgggtatgttacagaggtgagttatagatgagtgcaatgatataaggtttacctctccccatgtgccacccaccccccacaaccaagggggcccatataaatgtcccaataaatactattattttcacccccactaaaaacgtgttatcaaaacactgtccatgttattcaaacactttgtaaattctgagcagacttgctgccggttctccttttaaccctaggaaaacattccaacattaaccggtcaccagcgcttcgcctggactctgggaaagcgtcaatgggttttttgtggtgagttggtccttttactatttatctatggccctttctttgttgatgttacattttatttcaccaactcaggttcactctttggccctttgttctctgatggccagatctgccacctctgctgtgctttccaaagagggagggagctttaatcaccgttaggttgttcatgtttcatttttttttaagcaaatgtcccgtaagataaaacatcttggcaaagacaagcagtgttgattctgctgacaagagcaagatactcccaccaaaagtttcacttttataagaatttttagaatttatatttcaccatgacactgaaatacactgaccacttgctttacaaaaaaacaaaaacaaaacaaaacaaaaaaaccccaaaccagagctacacatgtgtgacgtgaagtgttatattaaacccatggtatttttttcaacaaaaatgaccaatttaaactattatctttgctttaagtctatatatctacattgctaatgcactttgtggttcactgttaaaatatgaggaggtgaaggaatcctgaaatggaagttaataaataaacacactaatagttgcttattacaaaagataaattatcttctcctaaagattgaatcaagagtctttggcaacagcacaaaatcatgacttaccttttttatgaaagtaatttttaaactgctaatgaatttctgtatttagctgctgttttatcatcatcattatcatcatctttttcttcttcctcatcatgtatatgggaatatataataacaagaaaagccacattaggcaaagaaagtaaaacactctcaagaaagtgtattttgggaacgtttggctaattgttgctacactatatacgaaagttatacggggctccatctatcttgctcatttttctaccctgaaaagcctggagcacagtaggtgcttatcaattaaatgaaaagatttactaaacctgtgtgctggaacagctaacagaggtcagggacagtgtcaggtcttaggctttataaccacaaggactaaagttttttcctaagagaaaaagaaaacaaagatctttctaaattaaaagacatgatattttcatctttttcagactttaaaatatatcatttttaagaccttttctatctcaaggttcttacattgtggcatggcctttgtctgtatgtccatgctaagcttcttccatagcaaaatagaaaaaaagaagttagtgctggaattgtagtacagctgctaagggaagcaaacaccatgtcaccaaggagaaatgttaatctgaatgtaaatcaattgtactttactaacagagttgacagagtctatgaaaattaatgtttcaacagaaggcacacctatgatacaggtgcagcaagatgtctacacaacaggtgggcagaacccaaatcctgttgaccaaggcttcaatatgacaggggtagctggaattccccaatccagaccctatgtgagaaaagtagggagaggaagtttgggttgggggcagaaataagtaagcccataacataaccaagtaagaaacagtgagagggaaggagaaaggaaggacagacaacaggatagaaaaccgtcgcagtcattccttaaaggtctccctttccagacttctaagagaaaacagaaccttgtatcagaattgtatgtatttgtggctgtaacctttactatctttgtgagtctgggaaagctctttaacttctgtgtgcctcaatttccccacttgtataacagcataattaatatgaagcaattagaacagtacctggcacctacataggaagtctttcctactactcgccattacacttagactgagcttactttttaccgttcttac

SEQ ID NO: 400 - DNA, 8000 bp, Homo sapiens
  Locus number 12 genomic DNA region, Feature name CHR03P052525960, Ensembl gene ID ENSG00000168268
agaggattgcttgaaacccagtagttcaagactggtctaagccatatagcgataccctgtctctgtgaaaacatttttaaaaagaaaaaaaaaattgtaccaacctacagaattactaagactgtcatatggaaggtgctgctctgtgcagcaatctcactctgcacctgcacatatgcaggattaaatgggtgatatgtttcctgagcctatgagcatcctgtccccaatttcccagtgtccctccagaagcaggggctgcagggagaagggagcaggcaggactagatgtacagggtacatctagtacccctgccttgcaggggccccagctctaagactccaggggatccctgtctcagccacaaccccagtgccgatgacaaagcaggagctgccaggccagagggccagggaagccccacagtgtgcctggcagctgctgcactcaagaggcagacatctcgctgatgtgctccgtgcccagagcacttgcctcagaggcactctggggacacagggctccattcccacccctttcctttggagccaagttcagggtgtgggtgggggatcaggtgtggctggttccccaggccagcacagagcggctgctccgaagatctgtgggtgtagacaggagtcttcacttggatgcaagtgagacagttgactgcaacgctctagggagctgcttctgagccacccctcaaggcccagggttctggtgtgtcactaggaccctgggccttgcccttcccatggccctgagttcccggataccaactgtgactgtgactcttggtgcagaagacctgggagggtctgctcggcagtgcagccccttgctggcacagagtcctggttaggtccaggccttcacctctgcccctaaggatgttcccaggggcccaggggcagacagtcctcccaggaacaaagcaggatgtggaaacagccacagggcctggtggcctggcctgatttctagactagaagaaccttggctctggggcgacagaagcctgttcccttccataggtggtgtgggtggggggtgggggtggggcagctgagggtgtgtcccactcagcatgtccagcaattgccctcctttctcctcagccctagctcccacacctgcccatggtgccaggtcccagggccaactgctccctagcagccgtgacacttgtggatgccttagaggcttgtcttgttcaatcctcactcccatcctgtgaggcagtcccacttattcccccatcgtccggaggaagaaactggggctcagggaggtgaagtcacttgctccaaaccacccagtaacaggcaccggggttgagatcaccattcaagtcaccccacctgcattaatcactctgcctctcagcctagcctcccaatgtcaccacactgaggccaggtgggtgggggctgggggactgagggacctgttgcactgctctcagcccgtgggcattagcccaaagcggacctcggcgcccagaggtgtgaagctggctcctgctggtgctcaccatgggatcttggtgggaatgactttgctccttgtatgacaagaggagcttagagggctgtgaggctccaaagatgcaggcaggcccaggaggacaatgtccagtagatccccgtagtcctccctgaaacctccaaggcaggcttctcaggatactctgagggtcttctccgggcccagagcaaagacttcttaaataacgctgggccgcccctccacagacacaaactcaacctgggacctcgagggtggacagatgcccaaggcttcaaaatgaccattcctcaggggcctttaccatcctgcctttactggtcaagaagtgattctccgccaccccacaaagccggagtgaaaacccctgtctagccagttagaatcttccagacagggctactttgttttatcagacaacaaaagccacgtcacccctgggggttcctccggaagctctcctgccctgcttggcctggttccagtcatcacccaaccctgggacagagaggccccaggactgcgtttcatgcttgagagagggtgagacttgctgggggaccacccaactggtcagtgatagggtcacgacccaaaccatatctgtctgctgcagaagcagggccccactagacccacggagacaagcaggcagatgtccagcactctcagctctggggcctcactagtgcgccccagccggccccctccaagaaggggcctcagcctcctcacgccatttctcagagggagagagcagggacagggaggttaagtgccctttgcagccctagtctgggctccagggggcgggggtgacttggcttctcccagccttcgctgcccgggctgagagggggccggacctccagggcgacatcgaggtgtgtctgggaagtccaaccggtgtcccctttggtccggccgtccctaggagcccgttccgcccggcgccgctcgctggctttgtccacagcactctcccgccccaactaagggttggccgagaacaaggggttgggggcgtttccaccgcggcttcacggcaggcgggaccccgaaggaagtcggcgggggcccagcactccggcagccgctcgaggagccccgagctcctgcagaccgagccggggaacaaacctcccgcccgcccccgggcgtcggggcgccccagaggcccccgggatgaacggccggagcttctcgcgaaaagccgcccggcccttgcgctccggggccctggcgagccccactgggtgtttccccggaggagcggcaccctggggctcggtccgtccatcagtccacgcggaagacaccccggcgcacgtcccgccccggctcacccaccgtgcaccagtctccgcatgtcctggtagcgagcccataggtgcgcgctgaggtcggcgccgctggtgggtgcctgggcgggcgcggagcgcgggacgccggggcagtgggcgccgggacccggggggccgcacccagggcaggagggcgaggacgaggcggctcgcggcccgccgtggcctccgcacagcagccagcgccgagcggccgcccgcagccccgcacccgccatgcccaccgcgcgccgcccgccgcccgcgctgccctcggccagcccgccgcccgccgcccgccgccctccgactgcgcgcccgccacggtggcctcgtgctcctcacggcggccggccaatgggtgcggcgcgcggagcccggcctgccaatgggcgcgcccctcggcccggggggcgggaggccccggacccggcggggcggggcggggcggggagggctccccagccccctcccccagccagtctccggcgcggtccgggaggactctgcgccccccttcggccgtcacgccggcgatggcggcgcctttccctggccccagccctggaagtcagcgggcctaagagcggccgtccctgagaggctccggacggccgaggcgccgagaggagacagccggagcgcgacgggtaccccccgggcccccgggtcctctgccgccctctccgctcccgggtccgcccgccctaccctgcgcctctggatgcttctgaccccagatcctccgctcctccccctagtcctggtgctctcctttcccggggtcctggtccccggtctctgggctcggactgactgcccactgaccagagcccgggccagtccactcactggtctaacaaataaagagcccttcccgcgcttcccggtgccaggcccacgctgggggaggccgaggggcctgcagggcagccgacgtccgctaaccaggtgactgggccgtgcgctgcagggttgtgggccacggtcactgcgcccgcttggttcggacctcggcaactggccgcactgacccgtcaactcccggtttcccggcgcacgcccctcgtgagatgctgtggtcttttctagcaacgtcgacaggctttccaacaaaattcctctttcctgcgcagaaccgctctccactcgcatttcttctgctcagatccgtattccgagcccgcacgcataccaggctgtgctcagggtccggaggaggccgacccagtagccgtgggccctgtcggaggggagccagctgggcgcgcgttgttttctgaggtggccgcgctgtctttcagggtgtgtgtacattcgaaactccactgaaccttgattgaagacctacagtgtggcagtccatggcctggggactggtaaggattgaggccgtaggatgggctcgagtgtggcggtgtccccagggccccagtgagcaagtgggtgtgctgggaacctggccacaagtgaacctcctccaggcgaggggatgccctgcagcatccagccgtcaaaacctcctgtagaaacgggagcgagcatcaagcctgtgtgtgtgcatgcttgggcggagtctacccggaggagaaagaggcttccgggctggccctccaaagccggttgtacaggcggcagctcaggctgctcactgcgggccctatgaccctttctggggccctgcttgctctctccagtctgcttttgtatattttgtgtccatatcaccaaatcgtctcattggttctaagctttcatttaccttccttagattgtctaatagttgtctcctttctcaaagctgttcctgcagtttttactttagtcctaggtaatggggtgacagcccctttcagttatcttcagcaagcacagcagcatgagaagacgcaattacaagtgaagtctcttaagtcagagccctgcttctacctggcatagtctcttaaactgtcagttaagagactacatataaacaatacacgttcagactcggcgcggtggctcacgcctgtaatcacagcactttgggaggccaaggcaggaggatctcttgagcccaggagtttgagactagcctggccaatatagtgggacccccatctctacaaaaaattaaaaaattagccgggcgtggtggtgcacgcctgtagtggtgggaggatggcttgagccggggaggagggggttgcagtgagccgagattgcgccactgcacttcagcctggatgacagagcgaggtcctgtctcaagaaacaaacaaaaaccatgtttgggaatacatgtgaagagcgagggctctgccaatcattatcatcataatgaatattctaactaatattaatcagttactatgctccagggttgtgttcagtgcatcattcctattaccgcactaaattatcacagcgtcagaacaaggcctccgttttacggcttagggaattgaggcacagatgggctaagggagcacctgtagagcagggatgtggtttggtaacagagtgcatgctctttatactgctcttctgcgattattgtgaataaagcgcctacaagtgcctgtggaactgtaagtgccccatacaagatagcttttattaattttagggttctcacggggcgcttacttagatttttgctgtgataattgataaagttcagctttcaacactccatatcaaattctgttactttagaagtctaggcaccaatcacgtctccgaaataaacgcaaggcattgcataattgcattttggaatgtggtgctgtacatagtccatcagagagggtcatcacttctatctgggtattaggaataaaaatggcggtggcagagtagggggcgcggctgccaactgcgagctcagacctgcactggggaggcagggggcggggccgggccggcgccacgtgggctgtccttcccttttgggccgtcccacctccagagctgaggcgcctgcgccagctccttcgaggccctgctcggcttcagggagcacgcgcgccctgccgtgctctgattggcggagctgcacgcccccgctgcagtctgattggcggatccgcctcgctttagaaggtcggcgcccagttccggcactcgtgcgcctaccagacagtggcggaggacggcgctcgctagtctcccaggtcgcggtacacggcgagaacgggcggggcggtctcggctgcgtccgggcgatccagtgcttagttccgtcatatccctctccacgacctcggtcgagcatgttcaccagggcccaggtgagacggattctgcagcgggtgcccgggaagcagcgatttggcatctaccggttcctgcccttcttttttgtcctgggaggaacgatggagtggatcatgattaaagtgcgcgtgggccaggagaccttctgtaagtgagggggtagcagtctctgtttcctttcaggaaggcacgaggcggtagggatccgtttttctggggagtattctcagattgcagaccgcgcattccactcagagcgctgggcgagtgcagttccattcgcttggcagtcagggcggcctggctctcctgtaggccgggcacattggcgtccagccttgtgaccttccctgcacttacaggcgagatcacgtgcttcttccagccctctcatgcctgcccttcacccctgccggtgacatcgtttgggcttaaggaacagacttgctcacaacaatcgtagaagggggtggatatgaggggtcagggaaactcctgctaactagccatttctctttggattcttctgtccaaactctggagggagctgatctgcctggctttgctaattaccactacctttacaggacagtcattggcaccaggtctttggtctgggtccagatgatcagcactgtaaagatagtggtaacgcctggcactgcattactgagcattaactctggacaggccagttcctttcaggaggacttccccaacccctcggccctttctgctttgcccctctcctgaaacgctatcacttgtgacttgccaacccacattttaaagaattgttacattagtgattcctaaagatccttagtccttctgttcatccattcattgatacttaatgagcattcttgaggggctataatgaacaaggcagaggtgtcccttaccccagaagagctctaatgggaaagaagatgataaagacaattagcatacaaagtgatcagtgctgtgagaaggaagtgggaggaacataggactctcgggtgggcgcctcaactggactagatggtgcagggaaggcttccggaagcagctaccaagtaaagtaggacctgaagactgagtaggtgtcagtcagatgaggggaaggtgtgtggaattgaaagcatctccatggcagtggtaggagcacttgtgtgagagtatgctgtgtgtttgagggattgaagcagatcaacaaagtggggatggctagaagggtgcctgggcagggtggcaaagggactggagaaccaagaatggatcccaaggattgagtcattttagggagaggctttaacatgtggagaatggctccttgtggacagattggtaggaacagttacgctgtatggctgtccagagttgagacagtggcctggtctaggttggggcagaaaggataccaagaagggatggaagtaaaagacagcccagaggtagtactgacagggcatggtgattaagtggactcaggagatgaggagtggaggcttctggtgggacacctggggcagggggtagtgcatttcctgaaggtgccgaacacaggcagggccatcctgggcaccatctgggacgtgacgaggtagatatggttatacagagctgaagctcaggaggcaaatctgggccagaaattgggatttgtgaaccattcagaagcaaattatgatggaagtcaaatcccaacattttaatttaatttatttattttttgagactgagtttcgctcttgttgcccaggctggagtgcagtggtgcgatcttggctcaccgcaacctctgcctcccaagttcaagtgattctcctgcctcagcctctggagtagctgggattacaggcatgcaccaccacgcc

SEQ ID NO: 401 - DNA, 8000 bp, Homo sapiens
  Locus number 13 genomic DNA region, microphthalmia-associated transcription factor
gtctcgctctgtcgtccaggctggagtgcagtggcacgatctcggctcactgcaagctccacctcctgggttcgtgccattctcctgcctcagcctcccaagtagctgggactacaggcacccgccaccacacctggctaatttttttgtatttttagtagagacggggtttcaccgtgttagccagggtggtctcgatctcctgacctcgtgatccacccgccttggcatcacaaagtgctgggattacaggcgtgagccactgcgcccagccctgatctctcatttttatcagtttgtttgccaataaaaatggcccatcacttccagatctttaaagttgactgaggcttcactgttcagatatggtagaattttgacagatttttaatcattctttaataaggtggagtgtgaggttggggacccaggaaaagaccacagagagattatggaccattgctgaaaaatccagcaaaaagcagtaggattgacagagggcaggtgagcccccagattggggcctagcctgggagggttcttggcattgctcaggaaagagttcaagaacgagctggtggtggaagaatgcaggtctagtgaagcaacagtgtacaacagagtacctgctccttgcagagcagggctaacccatagacatgcacccagagtagcagcgtatggactgtagactggcagtatttatacccacttggaattacatgcaaatcaaggtacaggttactcagaaatctctagaaaaagggtggtaacttttgggagttgccatggcatttgtaaagtgtcatggcactgctgggagtgtcttatactgatgagcagtgagggcacctagaggttgcctttggtgccatttgctagttctggtgggtttcttcatttcttcctgtggagaccaggaaataagcgctggtagtctctacttcaggatggcttagaaattctggtgtaggcagtttttgaggtaaccaggctcagcttactcagggcctagaggataaaggtgatgattttgacttttgcaagcattggaaattagcatattatagttatcagaatggtcattattgtaaacattaactgagtacttgttgggattgcttggaattcttttagaaagaaggagaaaaagaattggtttcagtaggttctgtactttcaagttacatagcagatagatcacacaatttagtgacaacagagcacaaagaacaataataataacagtagcatctagcatttttaaagccctctttacagatatgccttgtgttagtgctttagcctatcttttatatatttctatagtattcttacagattatactggagttaaggaaggtacctatgtaattaaaaaaaattctttctgtgttagaaaagtgaagaaacagaaacatcaggaattaataatttacatctaggtgaattataaacatagtaaggcacttactatctaccaggtacagtatttaagtgttttatataatataattctaatatgaggtagataggatcccattttataaatgaagaaacttgtgcttgtctgttttctgtcacttgtctatcttaagttactcaaataaggttgaaccgcgattcaaactgaggactgtctgacttcaaagctcactctcttattcaccatgctggcagtggtttccatgtattttggtgttcggaggtttggagggagaggcaggagtgatcaggagtgacaacttatgttgatttttgaatggaaaggagactaggtttcttatgaagtaaaggcagaagactcagggtgtggttgcacattcaaatccaaaacaaatagttatatctattaaaggtgctcacagcatgcctgtctgcatagtcctttgtttctaaagctgcttctgaaggaggaaaggaggtaggctgtgaatcctccaagaaaggtaggaaaagatgggatggtggatacttaatcattcacaagggtgtggtatataagtaagtggtagattttcctaatttcttattaataatcttcaaatgttgctacttgatgacatcaagttgtcttgtctacatacccatccttgtgttctactactgaacatgaacatgtagctcataacatctggatgtttttcactcatctctttttccctctctcttttttctgctaacctgacttgttgattgctatttttgtgtgtcttcataaatttatagccagtctgttccattctggactgtttatctttggcatgccagaggtctttaaacatcataatgttgtgtaatgagcataacttctgccttgacttgtgggtgttaagagcattagtcagtgcaaagtattgagttaaatattttcaataaaaggatataatgatctagcagagaagaagttataaaaaatcctagttaatggctttaatggtgagccatatatttagtgggttctatcagtgatgagttagagattcacagaatgaatgtaaaagcattcttacttttaattaatgagagaggagaaagaaaaacaataataagaaaaaaaggacttgattctcatccataccaagaaaagtgtaaacatccaagttcccagtgattctaaccctgattcattaccttgcatgtgtctttaactaccacaagaaatgtttaagatttccattgagatattatcgacagggactcctgggctgcatcataagcctgattgaaagcctttagccttgtaatgatctctttttggaggacaatcagggaattctttgcacctttatcagagagtcagggctttcctgagcaaacaaactaggtctttacctatggagctgattttatgaagagttttggtcagcattagtcattgtgaaaccatgggcctcctgccctggtttatctcgacagtcatctccctacagcagaagattgaatcctcatctctccatgagtctgagcatctaaagatgttagaggtacattggtttgattcttgctggggaatgtgtagtgggtactggtcttctgggaatagtgtctagatgaatgtttaataatcagtttaataggttgatgggctgtcttatttcctggggttggaggtttaaaccaggacaccctgtgctaactctgctctttaccttgccagcaatcctcagtcgtcctggtaaacaacctctgagttaaataccttttcttttctggagaggttaccaacaaaggaaaaggctttgatgtcagaacagggggcataaacagtgtttatggctgctgttaaaaatttctcatctgggtattttcaaaagaattccaagtcaaaatatatcacttatgggaagtatcttcttttccaatatgatatcttatgaagttgataattattttcatggtttaagtagtaattgatgacattttgggggttggaagatttgtgggaaggaggacatagattttcatcagatgtccttgcgtcctttccttgcgaggattattgatctctagtcttcatatgtaaggtgttgaatttatttaatgttattaactgaatctatagataaagaggtagttttggagccaagtaacctgttgatgtaaagtctattttaccttttatgattaccatctagcacctccctccttcctggctgaattccctgtcattttaagtaggcagcaattactggtttgctaaagaagccagctcctgctgccaaggatcctgttaattatcactctatctctaatttagccttcctagtgttgagagaaggtgcacgtaagcgtgtggcagaacgtctgcaatcgcatctttgtaataatctcctttctgagacggttcagtggactcaatgttccgccaaagggccaaggcagccctggtgagtgttttcagctctcttctgtagcttgtttggtcagtcgagtttggtgtgattgtcctctccttttgcttctgacctaagtaaaagctaatggttggcattaatcttgggaattcagacctattccgctccatctctgaagtcaaatgggacaccttgaaaatacttcagtggttttcccacgagctattttctctctctgtgaaaaggaaaccaggaaattgactctgtgcctgttttcaagaaggtaatacagatgataaccaaagtacctcagtttacaggttcttatatagcatgttttttaagggatgtcaatctttatatcgtatgaaatctttggttcttgttcataaatggctagattgctttctgtttgttttcggaaatgttcagttcacttgtttcagtgaacattttttcagaagttccactggatcatttgattaggtttggagtgcttatgcttccttttccactttttatgttatttttggcagtgttggtatttgaagctgtagaagtgattcactgcaaagtgcattaattttccacatttccaaatgcattttccagtggtccccaaatttcttttcctcttctcagatgattctgcagttgtccttctgtcattctgctggctcaaacataaatgctgatgtcactgaatttcttaaattacagctggtggggattaacagaaattgtaaaagaataccacttcctcattttgctattttcttgactaattattgtcttttcaagtactgtaggaacatagggatttgaaaatgaattctttgtcttgcagtttaaacagcaattttccttttcctttttctgttatacttcaaaaataatgtagcgcttaggatgcttttctgatgtgccctttaataaccccagacagaggagtctcactcctgattttgcactttggactgtcttctaccctgggtgaagggttttgaatacttcccttaagtaagtttccttatatagaatatttttactcaacagtttttctccgactcaaggccgttactggtattatgtgaaaggttgtgattaatttatttgtttgttcagagcctttgctcctttaaggaatgcttagctctgtcctcatcattttcttgtttaggatctgtgttatttgtgacaattttgattgctccagccctctacacattaatttttctggcttgcctctccttgttttaacagtgggagtctgggcctcaggctttcttatcacttggtttgtggtttgagtgatggttccatgaaccttttcctgggagttctctgggctcctgtgctggacgctggaagccatctggaagtgtgcacacaggatggctgggtgctgctgggtggtattgattgaactgcagtcccgtggaaacagaaatagaaagggttcagcattcccactttcctctggtggcatttttgcttattttgtgtatttagaaaaggtagccatatgcaaactgctgacttactattttccctggaatggaaaccatttggattatttcaatgagttttagcgaagatttgtttgttcacagtattagttttgttttctggtagcctgtttagaataagaccagaatgtgtctttttactttatggaaatgagtgcttacttggtgtttggaattttgcaaaccaacatgaatttgaaaagtcatatgtttattccagagtcaaaatagaaactctttagtgaaaattatagatatttccatcttggatcatttactttctgtgaaaaatttttttttgacaaaattgtttaagatttcagaggaacctcttttcctggttaattttcccacaaattaatttccctcatttttaaaaagaaaaataagattaaactgaagaattgcagaccaagctcatatgtgctggaatatttgctgtaagctggtgactgattctttgctgttatctttcataagagagtggatttagtttaactgttagtagttaaggtttggattaggaatacaaatatgattcccttaccataagaccttttaagcactgatttgcattgctgaggataagttatgattattcagtctcgggaaaatttgtattataagatccatatacacttagccaacattgccttctaacattgcaatgataagttcttttaattgagattttggaatggtatagctatctggaaaatatttcaaatgtcattgtggagcttttggttaaatgtgagttttaaaagtttgataaatagaataaagagcggaaaggaaaaatagttatgaatttgttgaattgtttgggctatgagttatctttttaaaaagaggttttatgtttgtgtagaaaatgccactaaatataagaaaatggaagtttaatagttgaacaaggtaagaattgcagatatcatgagattgtaatttaactggagtatgcattaaatgaattgtatatttcactagcttggtgaccatgaatggttttgtttgtcattttatctttcttttcttttctttcttttttttttgagatggagtctctttcacccagcagcacgatctcagctcactgcaacctctgcctcctgggttcaagtgattctcctgcctcagtctcctgagtagctgggattacaggtgtgcaccaccatgcccagctaattttttttttttttttttttttttttttttagtagagatggggtttcaccatgttggccaggctggtcttgaactcctgacctctagtgatctgcctacttcggcctcccaaagtgttgggattacaggcgtgagccaccgcacctagcctctttatcattttgtcttatcccagtaaataccatcatgctggaccttgtattaaaaaaatgttgaatcaatgaatgagtgaatgcacgttttgggaggcctggttgcagacctatctgtgctgctacctactcatatgaccctgtgggtctgtctcccgctatatacaatgaaggctaaagatgggatcagggataagtatgtgggattgtgttgctccctccttctgctgcagtacggtagatattgccaactgtcacttcactctttcctgtgaacccaggaggagccttgggcctttctgaatttagtgcatcaggctcccatgactcaccgtagatacaagagttaaaacttactgtaccttctccttttggatttggtccctgaagcccaattacaaataggcaatattctatgatgtttcttggtcagcagatgttcatttaaacaatagagacaacagcatgcaccattatccctccattcaataatttttctggtagatttagcagatatattaatagatagaacttaatgaatgggtctagacagtattcttccagtggagtaagatatgaagatataattagattagcagagtttttcacttttactctccaaagcacatgtctccatctggggcacagttatggagcacctcctgtatgccagcactatgctactgataaatggccagcctgtaattcatgggctctgccttcttgtaactcaaagtgacataagtatgatgctaggtctgtaattattcctttaaagacaaaagatggaggggcatgtaatcctggcactttgggagactgaggtgggtgggtcacttgaggtcaggagttcgagaccagcctgaccaacatgataaaactgcatctctactaaaaatacaaaaaattagctaggtgtggtggtgtgcacctgtaatcccagctacttgggaggctgaggcaggagagttgctggaacccgggaggtggaggttgcagtcagccgagattgcgccactgcactccagcctgggcaacagagcaagactccatctcaaacaaaacaaaacaaaacaacaaaaaaacaaaaataaaaaatgattgtcaaacagatgagaggaaagcattccaggtagaccgaggcatggaggtgcagcatagtgtggcactgagacagtctaagcacggagtgtggctggagcaccagggagtgcggccagcttcatacagaggaatagtgctctggctgccaaatgaagaatgggttggagggtg

SEQ ID NO: 402 - DNA, 8000 bp, Homo sapiens
  Locus number 14 genomic DNA region, prostate-specific and androgen regulated protein (PART-1)
gggattcaaaactgctaattgatctttcaaatcattcagaaggtcattttgaccattcattgcatccctgagatgaaaagactactaggaataagcatcacctcaaaacctacataattatttccttagcaaaatttaataatgagagtcaagacaggaattaaaaaaaaaaaaaaaacccaagaacatctgtcagtctaaatttcctaacccactttttcctgtgaggaaaatatgtcctctaaaacttcgtcattggcagctccaaatgtaggctgtgaaggaatgcttatctaactattggcttagtgctgtatctaagtggaaagaaagcttaaccaacaggaacattcatcctgtttgagggaagcaaacatagcttagaaagttagtcaatccaatcaataagaaatatatctgatactttccattttaaaaattgaaaatttgcaaagaatttttattaatatactgataattgttgcaatatgtaatatttatacgactatggcacatggaagtttactaaatatgttttcacatacaatgccacattcgtttatcacagtaaacctatcggtatttttaatactcaagtaatagatggatcagcattgaagctccaatgggagcttcaatgggagcttaaacaaatgtaaggtccaaaagccttcataacattaggatcaaacagtgaagattttctttgcttcaaaagttttgtccattactgggaatatgttttagaagtaaagagtcctaaccctagcgtgatgagctacagtcataataatagtgtacatgtacagcacattacaaattacacattacaatgttcttttgacaagcactttctcattgtgatgtggatattcaccaatctagtaaaataccagaacatatatcattattttcattttaaagacatagagactgaggcttagaaaacgtttcatggcctgagcgtggtcccgttgactctaagattaattcaccaaaatgttctgcttcttgaaatcagatattagaggaacacagttatagttaagttggaatcactgattgtcttgaaattaaatgaaagctcctcttctaccagtgtctagctccacaaaaggagggacttaaagaaatgtagggcatttaactccttggtggtgtgctttttctgtgggaagagggacatttgtttcattcgttttgttctgcttttttaaaaacatgctcaaggtagacagcaactcttttgaaaacacaaagtaagaattattaaattcttgggcaagctgaagaaatcaaatcagtcctatatataacacaggaaaaacgttggagggaagagcaaatttttccaaaaacaaaattcaccaaaaaaaaaaaaacccactggaaaatgtaattcaatcaaaaaattatattttcttcaatttggatttatgtctttgcttcagtaggtagtgttaatagtctccaaatgccagtgtgtattcatgaacacttagcaagttcatgatgtgatacattcctttttggatacatctttcgtcaaatccatctgtctatggcagatatgcatagttttacagaaccttatctgcaaaagaacttccacagttagacaaaaatggttttagaaaattgagaggagtggatagaagaaagatcaactattgctgtttgggagattttttttgctttccccaccatgccttgcccccagcccactgtccactgggcacctggcacctctagactccatttcttaaagctctgttctttcacaagtaagagatatgactctggcatctcaggaagaactgaagtgatggaagtcccagaggaaagtaccgatgcaagacgtaaatactcctagtatacacccaccagaatttccttgagccttggttttaaacatcctctgaattatataggcagctgattaatgtttgataattaagcatttttatgtgattcatctcaataagagcccaagcaaggtaatgtaaacaatgaaggcataaaaaggtggaaggagatgtgaatactacaccaagtgggccacatggacctaaggaaaaagaggagctgagttgaagtcaggagctgattcagataaagcagcttcaactctactacttcttactcttagatgggctccagaccaccttgagggatgggattatatttattttatagatgcactcctttctcccactaatacagtcagttaggaatgtatagctaagaatgagccaaccattactattcgtgtctatggctacagaaactcaataaatcaactcactattctgggtcaataaatgaactcattatactgtttcttcatgaagtaaatgtgtttctaaaggaatgtattaaaattacatttttaaaaatctatgtattttgcatatatttgattgatacagaaaaggagtctacgttggctacttttctttctttctacaaacttcattcattggtgtgatctgaaaggggataatatttcagaaagcaaaaatatttttaacaacaaaactttgtatttccagtgtgatctaaacacaaaattatgcaaaacacaactaatatttctctcctactggctaaatcatgccagttgtttaggtgcaatcaaaaataagccactaatgttatttttataggaattggcaagtaattgccaactatagctattaaaagtttatatttgccacaggagcctgtgattttaaatactgttcaaatgatttatgcttgagagttatacatagcacaaatacatacatttgtatctacaggtctaaagaggaaaaattagacaaaaagcaacttgaaaaggaacccctttatttttaatgacctacctttgtgctgtattgagaaaaagtataaaaattatttgggaggaagaaaaatatttctaagcactaatttcataggcaaaagccctattattttttatgataggctaggggaaatcaataatgatttaaaagcaaacagtaaactgctcacatttaccagtctatactcagtattaattctaccctgcagtgtatgctatagaaggtaatgaaatgctgatgttttctggttttccacttcaatctgctccagctttatcctaaaccttgtcagcaacagaagttaccccccagcaatcatacaaacctaataacggcttccctggcttaatttgatctgctccaatcacaaattccaatccacatactttcttctgttatggttgtgtctgtatgtgtttaatgtactttttataaggcttttttacaacaagcgcatggtttttcattcagccctctaccacataaacagaaccactgaagagcatttttgttcatataaaaatgttttagttattcatagtgtatgtcttcaattggctgcagattacagtgaacaaaagtattgctgccatcattttacatttctcctgttactgtgccctatctgctgtgtacccctgtccccaaagcatttattataatatttgctgcttgctctcagttttggactgagatgcttgggggtgggaaaacttaaaacttgcctgactcaagtgctctctaagctttgatcccagcatcctgctttaacctgctcctgttggacctctgccactttactgaccccataaaacaaacagagctagcaaatgcatcaaacagcctccttcaaaatgcagcttgactgtgattcatggcacaaagctggaataaccctgccagttcttagaagctttaagattcatcgtcttgaacttgatacacatagtatagcaccttaaaaacgaatcatctgctagttcagtattttctacttacaatcactccctcccagggcatgtaattaatttactgagcttaaaaaaaaaatatcaggattactcacacagtcttgaagatgcaatgtcagctatttaggacagaaacatccaaggccgtgtcagaactcaattacgactacatatgcattaaggcaggaactggcaggcctcagggtacgccaactataggactcgtgcttctcgtacgctgggctataatctatgaaactgagctccagagccagccaatcacttagctcctcataacaagtctaactggctctggaaagctgaaagggctgcactggaacaacacagatgagatattctacacattaatctacttatctggaatcactttgcctctaaaggccagagaaaaatcacagcttccttgtcggaggggaaaaggacaggtgatctggggaaaacgcagctacacctggagcaaggtctcttcccggcttggcaatctcagctgtgccggcgctacgggacccgagccgtcccagaaaccaaagggcaggcacggcagcaaacgcctgaggtaattttcatctttctttttatttttagtagaataatgcagactgaaagtgataagcataaagtcgctgaggcaactagatatgcttcgattttattttacattttcctattctaatcgtgtgcaggatcatttgttatgaagtctgaggagggggagaattaatgtacctgaaataaacttgaaactaaaacgatcatttgtggaggaaaatacaggattttccagaacagtttcagagctacctttgcagatgggtaggcttttcacccacccacagaaagaagagtcaacggggctgagacaggacagggatgggtttcaggagcacaattaaaagtttttcgtatcttaaagaaaatatctatgttcagagagaaaattgagaagataagttactgcccagttcctctggtctttgacacttagaccacataagaatgttccatggtagaagggttgggacagagaatcttaggaatcctaagagagaatcaatactgctcccctaccccaggtttttcttgttttctttacaatagtatccttatttcccattacattttagtgttagtcataccaattacttgttacaccatacttctacatttgcagttattaaaggatctgcagaaaacattttaaagtcaaaatgattatagaggcaactaaaataagaaagcaaaaaaatatgtgaaactgacatacacataaccagaacaccacaccccttagatacttaatgtacttaacccaatgacaaatccttccaaatccttagcaaattgtctgtttctttaatacattttgtagcaagtgtaacattagcaacgaagaaaaactttggcaataaacttgtacataactaaatcaatccttatgctttcatagtgacgatagaatatacataatattttatttgttttgttggacttataaaatcctaaggcaagaagctgagaagaaaattttgctttatttagtggtgacatataaacagtaacagaagagacatttatgcactttttttggctgtagataattgactgaattcaacttgagatttgacaccagaaagaaaaacgttgcaatagacagaaaacagaaaaagtaatccattggcaatttccccccagggtttgttctttgaattgtccaatctgtgactagccagggaagaatatttctgctctgtttaaatagtttttatttaattaaacctttgtttatttgacagtgctgctgccttcggtgactatatgagaatggaaacttctaaggaagccaggttgttagaattgttaccccctttactcagagataacatagattatccaggctgagatggaaaacaagccctttattgaattttcaacacagactccctgcttctcatctccttaataaaatttcattaaaatccccttgaactcccatgttcaaatctccatttgttgacagacaaagccaacaatactctaaactgaggcctgcaagtcatttcatttgtatttttgtccagaaatttcccataggaagacttcacctcctacaactccgaagaaaacccttactgtccaagaccgtcaccagcaaccatccgcagtcattcaagtggaagctttcacagcttttgtacattctctgtgtcaatatacaactgagttacagactgtcccctggctccctgacccttacaaacactaaaagttttgtttgactcaacttcaagctgctcatctgttagtaagtgatgttcactccagaacacattcatgatgagaactttctaaaagaccagcactgctcttcccctcctataatcataataatcatgataacctgaaacatgttactgggactcgacatttttctggggattgaaatctttagtccttggagctgtcacatagcaggggcaacctcacactgaaacaaaggaagtgatgtcccattattatccaccctgagccaccataatatgctgtttacatttattttcttcagcctgtgcaaaacaaagcaatggaaaaggaaactaaaaaatatacatactagtaccattatcttcttttgcctaaaattactaatgcaccacgtcagtctgcttccttcaggcatcattctcaattcatcaggacttgtattagcaggttctggctagagagactatctcctgtcatcacgatcaattaatgttttctggtgatcacatcaggccctatctaagaagctcatggtatacaagggtcacccaaatagctgagtgcagtccttgctcatatttccttcatcttaaccccgcaaacaagaattaagatgatcccaataaaagaaaaattgctcaggaaactgaacctttttctgaaccaagcactgtcagcaaatctcaggtattagagcaactatggttgattgaaaagtgtctcaaaatctgggccaagaatgattgctaggtccataagctaatttgtctggccttgccatttacgtaagccaaagaaagtcactcatgagtaaactatagaaaacgttcagacccatcctgttagtatgtcaaatcaactaagactggcagggtattaactccattccaggtgacatggataaagagccccattattttcacagtgccagcctctacctaaggaaaccctagaccttggaaccagtttcctggtagggaactgctgacagtttcaatgctgacagttggagccaatgcctcatagtgtaaactgaaagaaaaatagttgctttttaaaatgtcagcaagaaggcctgcctcatcttaacaaagcaaaaaaaaatgctttaattcaaattaaaaatcatgatactagagatgggagtctgtggtcactataaagataaagttcatgttcttggttcagataacaaaacactttatctggataaatggacctcaaaatttgctcttggcacatgggggaaattttttgttgtattttgttgttgttgttgttcttgttgttattgtttaaattaatcttcctaaggccatgaatatgaaatcatattaataatgcatgtgacaaaattctaaaatatattacacttaaaattagcataaaccatcaacttttagtactcatatattgcagtcaaaactcttctaggtaatgagacctgaacagaaggatccatttatctgtggtcttgctctttgtctaagtttctcgaaagcattaggacaatgacatatacaaaaactggcaattacatttaataagaaaaatgtggggagtgcattcttaatatttgatgctaaaaccatatctttgctttaaacatgtaaagcagtataacatggtggttggtagaaactctggagtcaggccacctgggttcacatcccagctctgactcttaattgttagaccctgagcaagctacttaacagcattatgcctcagtttcctcctatataaaagggtgccacacacagtaactacctcctaggctggtgtgaagattaaatgggcaaatacatgcttagaactgagcctattatatggtgactgctcattaaaagaaaattgtcgggagggatagcattgggagatatacctaatgctagat

SEQ ID NO: 403 - DNA, 8000 bp, Homo sapiens
  Locus number 15 genomic DNA region, prostate-specific and androgen regulated protein (PART-1)
cctcaaaacctacataattatttccttagcaaaatttaataatgagagtcaagacaggaattaaaaaaaaaaaaaaaacccaagaacatctgtcagtctaaatttcctaacccactttttcctgtgaggaaaatatgtcctctaaaacttcgtcattggcagctccaaatgtaggctgtgaaggaatgcttatctaactattggcttagtgctgtatctaagtggaaagaaagcttaaccaacaggaacattcatcctgtttgagggaagcaaacatagcttagaaagttagtcaatccaatcaataagaaatatatctgatactttccattttaaaaattgaaaatttgcaaagaatttttattaatatactgataattgttgcaatatgtaatatttatacgactatggcacatggaagtttactaaatatgttttcacatacaatgccacattcgtttatcacagtaaacctatcggtatttttaatactcaagtaatagatggatcagcattgaagctccaatgggagcttcaatgggagcttaaacaaatgtaaggtccaaaagccttcataacattaggatcaaacagtgaagattttctttgcttcaaaagttttgtccattactgggaatatgttttagaagtaaagagtcctaaccctagcgtgatgagctacagtcataataatagtgtacatgtacagcacattacaaattacacattacaatgttcttttgacaagcactttctcattgtgatgtggatattcaccaatctagtaaaataccagaacatatatcattattttcattttaaagacatagagactgaggcttagaaaacgtttcatggcctgagcgtggtcccgttgactctaagattaattcaccaaaatgttctgcttcttgaaatcagatattagaggaacacagttatagttaagttggaatcactgattgtcttgaaattaaatgaaagctcctcttctaccagtgtctagctccacaaaaggagggacttaaagaaatgtagggcatttaactccttggtggtgtgctttttctgtgggaagagggacatttgtttcattcgttttgttctgcttttttaaaaacatgctcaaggtagacagcaactcttttgaaaacacaaagtaagaattattaaattcttgggcaagctgaagaaatcaaatcagtcctatatataacacaggaaaaacgttggagggaagagcaaatttttccaaaaacaaaattcaccaaaaaaaaaaaaacccactggaaaatgtaattcaatcaaaaaattatattttcttcaatttggatttatgtctttgcttcagtaggtagtgttaatagtctccaaatgccagtgtgtattcatgaacacttagcaagttcatgatgtgatacattcctttttggatacatctttcgtcaaatccatctgtctatggcagatatgcatagttttacagaaccttatctgcaaaagaacttccacagttagacaaaaatggttttagaaaattgagaggagtggatagaagaaagatcaactattgctgtttgggagattttttttgctttccccaccatgccttgcccccagcccactgtccactgggcacctggcacctctagactccatttcttaaagctctgttctttcacaagtaagagatatgactctggcatctcaggaagaactgaagtgatggaagtcccagaggaaagtaccgatgcaagacgtaaatactcctagtatacacccaccagaatttccttgagccttggttttaaacatcctctgaattatataggcagctgattaatgtttgataattaagcatttttatgtgattcatctcaataagagcccaagcaaggtaatgtaaacaatgaaggcataaaaaggtggaaggagatgtgaatactacaccaagtgggccacatggacctaaggaaaaagaggagctgagttgaagtcaggagctgattcagataaagcagcttcaactctactacttcttactcttagatgggctccagaccaccttgagggatgggattatatttattttatagatgcactcctttctcccactaatacagtcagttaggaatgtatagctaagaatgagccaaccattactattcgtgtctatggctacagaaactcaataaatcaactcactattctgggtcaataaatgaactcattatactgtttcttcatgaagtaaatgtgtttctaaaggaatgtattaaaattacatttttaaaaatctatgtattttgcatatatttgattgatacagaaaaggagtctacgttggctacttttctttctttctacaaacttcattcattggtgtgatctgaaaggggataatatttcagaaagcaaaaatatttttaacaacaaaactttgtatttccagtgtgatctaaacacaaaattatgcaaaacacaactaatatttctctcctactggctaaatcatgccagttgtttaggtgcaatcaaaaataagccactaatgttatttttataggaattggcaagtaattgccaactatagctattaaaagtttatatttgccacaggagcctgtgattttaaatactgttcaaatgatttatgcttgagagttatacatagcacaaatacatacatttgtatctacaggtctaaagaggaaaaattagacaaaaagcaacttgaaaaggaacccctttatttttaatgacctacctttgtgctgtattgagaaaaagtataaaaattatttgggaggaagaaaaatatttctaagcactaatttcataggcaaaagccctattattttttatgataggctaggggaaatcaataatgatttaaaagcaaacagtaaactgctcacatttaccagtctatactcagtattaattctaccctgcagtgtatgctatagaaggtaatgaaatgctgatgttttctggttttccacttcaatctgctccagctttatcctaaaccttgtcagcaacagaagttaccccccagcaatcatacaaacctaataacggcttccctggcttaatttgatctgctccaatcacaaattccaatccacatactttcttctgttatggttgtgtctgtatgtgtttaatgtactttttataaggcttttttacaacaagcgcatggtttttcattcagccctctaccacataaacagaaccactgaagagcatttttgttcatataaaaatgttttagttattcatagtgtatgtcttcaattggctgcagattacagtgaacaaaagtattgctgccatcattttacatttctcctgttactgtgccctatctgctgtgtacccctgtccccaaagcatttattataatatttgctgcttgctctcagttttggactgagatgcttgggggtgggaaaacttaaaacttgcctgactcaagtgctctctaagctttgatcccagcatcctgctttaacctgctcctgttggacctctgccactttactgaccccataaaacaaacagagctagcaaatgcatcaaacagcctccttcaaaatgcagcttgactgtgattcatggcacaaagctggaataaccctgccagttcttagaagctttaagattcatcgtcttgaacttgatacacatagtatagcaccttaaaaacgaatcatctgctagttcagtattttctacttacaatcactccctcccagggcatgtaattaatttactgagcttaaaaaaaaaatatcaggattactcacacagtcttgaagatgcaatgtcagctatttaggacagaaacatccaaggccgtgtcagaactcaattacgactacatatgcattaaggcaggaactggcaggcctcagggtacgccaactataggactcgtgcttctcgtacgctgggctataatctatgaaactgagctccagagccagccaatcacttagctcctcataacaagtctaactggctctggaaagctgaaagggctgcactggaacaacacagatgagatattctacacattaatctacttatctggaatcactttgcctctaaaggccagagaaaaatcacagcttccttgtcggaggggaaaaggacaggtgatctggggaaaacgcagctacacctggagcaaggtctcttcccggcttggcaatctcagctgtgccggcgctacgggacccgagccgtcccagaaaccaaagggcaggcacggcagcaaacgcctgaggtaattttcatctttctttttatttttagtagaataatgcagactgaaagtgataagcataaagtcgctgaggcaactagatatgcttcgattttattttacattttcctattctaatcgtgtgcaggatcatttgttatgaagtctgaggagggggagaattaatgtacctgaaataaacttgaaactaaaacgatcatttgtggaggaaaatacaggattttccagaacagtttcagagctacctttgcagatgggtaggcttttcacccacccacagaaagaagagtcaacggggctgagacaggacagggatgggtttcaggagcacaattaaaagtttttcgtatcttaaagaaaatatctatgttcagagagaaaattgagaagataagttactgcccagttcctctggtctttgacacttagaccacataagaatgttccatggtagaagggttgggacagagaatcttaggaatcctaagagagaatcaatactgctcccctaccccaggtttttcttgttttctttacaatagtatccttatttcccattacattttagtgttagtcataccaattacttgttacaccatacttctacatttgcagttattaaaggatctgcagaaaacattttaaagtcaaaatgattatagaggcaactaaaataagaaagcaaaaaaatatgtgaaactgacatacacataaccagaacaccacaccccttagatacttaatgtacttaacccaatgacaaatccttccaaatccttagcaaattgtctgtttctttaatacattttgtagcaagtgtaacattagcaacgaagaaaaactttggcaataaacttgtacataactaaatcaatccttatgctttcatagtgacgatagaatatacataatattttatttgttttgttggacttataaaatcctaaggcaagaagctgagaagaaaattttgctttatttagtggtgacatataaacagtaacagaagagacatttatgcactttttttggctgtagataattgactgaattcaacttgagatttgacaccagaaagaaaaacgttgcaatagacagaaaacagaaaaagtaatccattggcaatttccccccagggtttgttctttgaattgtccaatctgtgactagccagggaagaatatttctgctctgtttaaatagtttttatttaattaaacctttgtttatttgacagtgctgctgccttcggtgactatatgagaatggaaacttctaaggaagccaggttgttagaattgttaccccctttactcagagataacatagattatccaggctgagatggaaaacaagccctttattgaattttcaacacagactccctgcttctcatctccttaataaaatttcattaaaatccccttgaactcccatgttcaaatctccatttgttgacagacaaagccaacaatactctaaactgaggcctgcaagtcatttcatttgtatttttgtccagaaatttcccataggaagacttcacctcctacaactccgaagaaaacccttactgtccaagaccgtcaccagcaaccatccgcagtcattcaagtggaagctttcacagcttttgtacattctctgtgtcaatatacaactgagttacagactgtcccctggctccctgacccttacaaacactaaaagttttgtttgactcaacttcaagctgctcatctgttagtaagtgatgttcactccagaacacattcatgatgagaactttctaaaagaccagcactgctcttcccctcctataatcataataatcatgataacctgaaacatgttactgggactcgacatttttctggggattgaaatctttagtccttggagctgtcacatagcaggggcaacctcacactgaaacaaaggaagtgatgtcccattattatccaccctgagccaccataatatgctgtttacatttattttcttcagcctgtgcaaaacaaagcaatggaaaaggaaactaaaaaatatacatactagtaccattatcttcttttgcctaaaattactaatgcaccacgtcagtctgcttccttcaggcatcattctcaattcatcaggacttgtattagcaggttctggctagagagactatctcctgtcatcacgatcaattaatgttttctggtgatcacatcaggccctatctaagaagctcatggtatacaagggtcacccaaatagctgagtgcagtccttgctcatatttccttcatcttaaccccgcaaacaagaattaagatgatcccaataaaagaaaaattgctcaggaaactgaacctttttctgaaccaagcactgtcagcaaatctcaggtattagagcaactatggttgattgaaaagtgtctcaaaatctgggccaagaatgattgctaggtccataagctaatttgtctggccttgccatttacgtaagccaaagaaagtcactcatgagtaaactatagaaaacgttcagacccatcctgttagtatgtcaaatcaactaagactggcagggtattaactccattccaggtgacatggataaagagccccattattttcacagtgccagcctctacctaaggaaaccctagaccttggaaccagtttcctggtagggaactgctgacagtttcaatgctgacagttggagccaatgcctcatagtgtaaactgaaagaaaaatagttgctttttaaaatgtcagcaagaaggcctgcctcatcttaacaaagcaaaaaaaaatgctttaattcaaattaaaaatcatgatactagagatgggagtctgtggtcactataaagataaagttcatgttcttggttcagataacaaaacactttatctggataaatggacctcaaaatttgctcttggcacatgggggaaattttttgttgtattttgttgttgttgttgttcttgttgttattgtttaaattaatcttcctaaggccatgaatatgaaatcatattaataatgcatgtgacaaaattctaaaatatattacacttaaaattagcataaaccatcaacttttagtactcatatattgcagtcaaaactcttctaggtaatgagacctgaacagaaggatccatttatctgtggtcttgctctttgtctaagtttctcgaaagcattaggacaatgacatatacaaaaactggcaattacatttaataagaaaaatgtggggagtgcattcttaatatttgatgctaaaaccatatctttgctttaaacatgtaaagcagtataacatggtggttggtagaaactctggagtcaggccacctgggttcacatcccagctctgactcttaattgttagaccctgagcaagctacttaacagcattatgcctcagtttcctcctatataaaagggtgccacacacagtaactacctcctaggctggtgtgaagattaaatgggcaaatacatgcttagaactgagcctattatatggtgactgctcattaaaagaaaattgtcgggagggatagcattgggagatatacctaatgctagatgacgcgttagtgggtgcagcgcaccagcatggcacatgtatacatatgtaactaacctgcacaatgtgcacatgtaccctaaaacttaaagtataattaa

SEQ ID NO: 404 - DNA, 8000 bp, Homo sapiens
  Locus number 16 genomic DNA region, collagen, type XXIII, alpha 1
ttgctgtcaggaatgtgggagcaattcagtaaaagccagatgacctgggaaatacgtgaaagcatctgatgaagtagagggtttgatgattctggggcctcttaggctgaatggatgtggcccaagagagttcctcaaactgggaaccttgcccattcacacctcggggttaggagcaggtgggcaagctgcttgttgtgttaccaggtaagcagaggtgcgtggtgatcttgagagtccccgatgcccaccttaagctcttagcctctctgggaacaatcatgtctccagtgtttcccaaagggtgtgtccagccttcctgaaatgcaaatggggaggagtctttcccatagcctggcaggggccaggcctacacaccaggaggtgagggctggcttcagtggcctgaggctgccagggtcactgtccctgctcacagccccacacctgctcctctctgttgcccctggactcccaacttcccctctgcctgtgacttgctctccctggtcctgattgagcctctcttcctctcccattcagccagctcaggtaagatgctgcaccctggctcccagctctcagaagcatgaacccatccccagaataaagacaacaaccttcagggacttttccctaaaggagcagaatgggccaggctagtctcgaactcctgacctcaagcgatttgcccgccttggcctcccaaagtgctgggattacaaagtgagccactgtgcctagcctgagtcagttttttaaaataaagaaaacttgtggatttcatcaaatgctttatctgcatttactgagacgatcatgtggttttatctcttattcaataatatgatgtactgcattgattgattttggatattaaaccaacattgaatttttgggttaaatcccacttggtttataatccttttgctggattcctttgcttgtattgttgaggacttttatgtctgtgttcataaaagacattggtctatagtttctttttttgtgatgtctttgtctagttttggtatcagagataatcttgcttcagaatgagttgagaagtgttctcgccatttctattttttaaagggtttgtgaaagattgttattaattcttctttaagtgtttgttagaattcatcagtgaagccatccgattctgggcttttctttgtaagaagttttttgatcactgattgaatctttctctttgttacaggtctattcagatttttgacttcttgaatcagttttggcagttgtgtctttctaggaatgtgtccatttcacctatgttatctaatttgtaggcatacaattgttactagtgtttccttttaatccttttcatttttttaaggttgctagtgatgtaccttcctttcagccctgattttggtaatttgagactccagtgtttttcttggtcagtctagttaaaggtttgtcagttttgttgatctcctcaaagaatcaacttttggttttgttgattttctctactgtttttctattttccatttcatttctttctaccctgattttatgatttttttttcttttgcttgctttgggttaagtttgctcttatttttctagtttcttttattttttaatttttatttcatatttatttatttacttatttatttgagactgagactggctctgtcacccaggctggagtgcagtggcacgatctcggctcactgcaacctctgcctcctgggttcaagcgattctcctgcctcagcctcccgagtagctgggattacaggcgcccaccaccacacccagctaatttttgtattattagtagagagggggtttcaccatgttgaccaggttggtctagaactcctgacctcagatgatccgcccgccttggcctcccaaagtgctgggattgcaggcataagccaccgtgcctggctactctccttcaatttttttcttttttttttgagacggagtctcgctctgttgcccaggctggagtgcagtggtgagatcttggctcactgcaacctccgctcctccaggtttaagcaattctctgcctcagcctctggagtagctgggattacaggcgtgtgcatgccaccatgcccggctaattttttgtatttttttttttcagtagagaccatcttggccgggctggtcttgaactcctgaccttgtgatccacccgcctcagcctcccaaaatgctgggattacaggcatgagccactgcacccggcctcaattttcaaagatagttttgccaggtatagatttctttgttgatagtttttttccttttgtcatttattgaatatgccatcctactgccgtttggctttcatggtttctgatgagaaaccagttgttaatattattgagcatcccttttctgtgatatgctatttctctcatgatgctttcaagattcttttttttttttgagacagagtctcactgtgttgtccaggctggagtgcagtggcatgatcttggctcactgtaatctctgcctcccaggtccgagagattcaagcaactctcgtgcctcagcctcctgagtagctgggactataggcacgcctggctagcttttgtatttatttatttattttttttagtagagatgggatttcaccatgttggccaggctggtcttgaattcctgacctcatgtgatcctcctgccttggcctcccaaagtgctgggattacaggcgtgagccaccatgcctggccaagattcattttttttgcttttagcaatgcaactatgatgtgcttaggtatgtatctctttgagtttatcatccttggagtttgttgagcttcttagatgtgtagattaatggttttcttcaaaattgagaagatttggccatttttttcaaatattcctttgtttctttctctcctctgcttctgggactaccattatgtgtatgttgggacactcgatagtgtctttgaggctctgttcattttccttcattcttttctccttctgttccttaggctggatgatatcaattgacctatgtgcaagtttgctgattctttcttctgtcggcccaaatctactgtcgaagccctctactgaatttttcatttcagttatggtactttgcacctccagaatttttatttggttctttaaaaaatacttttgatctgtttattgatattctccatttagagggacatgattctcatgctttcctttatttcttcaaacatggtttcctttagttttttgaacatatttataataaccaatactacatctctagcaagtacatctgggtttcctcagggatagtttctattgactgtactttttccttttttactgccctactttcctgtcttctaattttttgctaaaaattggacatctaaactaatctaatgtggctactctggaaatcagatccctcttctcctttccaggatttgttgttgttgctgtttattgttgttgctctccgttgagggcctttcctggactaattctttaaagtgtgtcttttttgtcatgtgcagctactgacttctctgcttgtttagcttagtggtcaggttagacagagatttccttgaatgccttgatccaacgtctcccactctgtgctggcgggctgtgtgtgctggagcacagcttcaatccacctctgtgtgcgccggagcacggcttcaatgctgcacctgtgtgtgcgccggagcacagcttcaatgctgcacctcgcacagcacagcttcaatccacctctgtgtgcgccgcagcacagcttcaattcacctctgtgtgcgccgaagcacagcttcaatgctgcacctctgtgtgcgccggagcacagcctcaatccacctctgtgtgtgccggagcacagcttcaatccacctctgtgtgtgctggagcacggcttcaatgctgcacctctgtgtgtgccgctctgtgtgtgccggagcacggcttcaatgctgcacctctgtgtgcgccggagcacggcttcaatccacctgtgtgtgcgccggagcacagcttcaatgctgcacctctgtgtgtgctggagcacagcttcaatccacctctgtgtgcgccggagcacagcgtcaatccacctctgtgtgcgccggagcacggcttcaatccacctctgtgtgcgccggagcacggcttcaatccacctctgtgtgcgccggagcacggcttcaatccacctgtgtgtgcgccggagcacggcttcaatccacctgtgtgtgcgccggagcacggcttcaatccacctgtgtgtgcgccggagcacggcttcaatccacctctgtgtgtgccggagcacggcttcaatgctgcacctctgtgtgtgctggagcacggcttcgatgctccaccacattacaactctgcctttgtcttcatttcctgcttgaacaatctcaaggtcagccagaggtgagagactggggctccaagacaggtttttaatggacatgtacatagctgatgtgccttccagataccctagaataagctggagcttttcaaagctcctttgaacatctcattccctatatttttattgtaagttttcaagtcatccactggtgttatcacctcaagcagcttcaatgttcaacaattgctgctgattatttttgttaagcatcctggggacagggctctttgttctaagcaagctgtgcataggtcacttaaagacaagccttgggtatggtgcttttccatggagctgccagacaagtcaaatagtgacagttctctggggatgagcatttgcaagcttcaaacctgttctgcttcctccaagtggctgctagttttcacaaacaagtactgtggttgtgacactgctgtttgtttgtttgttttttcctgacagagtctagctctgttgcccaggctggagtgcagtggtgcagtctcagctcactgcaacctctgcctcctgggttcaagcgattcttgtgcctcaacctctgagtagctgggactacaggtatgcaccaccatgcctggctaatttttgtatttttagtagagatggggtttcaccatgttggccaggctggtctcaaactcctggcctcaagcaatctacctgcctcggcctcccaaagtgctgggattacatgtgtgtgccatgcatggtttttaaagctggtttttaaggctaccatgagcttgagagaggagaaaattaaaatgctacaaatcttactgttcttgttaagagcaaaattcagatatttcctgaataaacatttcttgggctgtggcaaaacttctgttcatttccagagttctgaaaaggtccatcttcccccttgtttttgctcctttatggagaagatctttagaagtcctcattccgccattccagaagtgcttcttccactggatttttagaaagagtttcttgggatcagggcagataaaagactctagcacagacactgttgcccgaaggctagcagctgcggagacccgggaagtgcctccgtttgtctctgtaggtttgtgtaggcactggccaagcagtcttctgtgatcttcatttgcccacaagtgcctctttctctctcccttctctcctccttcccatcaataagcatttatggaccatctcctgagtgggggcctaacctgccctgaggagcccatgctttggtggagaagcaggacaactctgcagaccaggccaacacctcaggtgtgggaagcgctgagatggagggaggtgtccagggctgcgagagaaggggagagtgatggacactcttggggataagagggtctgggaggagagaggatcctccaaagcccttagaaagaaagatgactccagagtgcaggcacagttctgggattctccagctaagaagccagccaggggaaggtgggaaatccatcccatttcagatagagacatagaaacactgcaggactgtggagctcctgctgggaactagggaggctactgcactgaaggcaggcaggatcaccctatctgcaggcctgcagcggcctcagggaggaatcccagccgggcactgccctacctggcaaaaaagagcctttctctgtgggcgcggtggctcacgcctacaatcccagagctttgggaggccaaggcgggcggatcacttgaggccaggtgttcaagaccagcctggccaacgtggtgaaatcccccgtctctattaaaaatacaaaaattagctgggcgtggtgacgcgtgcctgtaatccagctactgaggtggctgagacatgagaatcgcttgaatctgggaagcagaggctgctgtgagctgagattgtgccactgcactccagcctgagtgacagagcgactgtctcaaaaaaaaaaaaaaaaaaaaaaaaaaaaggctttctcccaagagacacaggaaaaaggcctccggcctccttatacaagggaaggcatgaaagccaggatgtgcatatgtgtgtaactatctagaaataaactcaaggcccagacaaggcccatcagagaggcacgtctgttctgtgtagctcactttgtttttggataggcagacaatcgggacaccacactggaaaaacaatgagggggagggatcctgcccaccccttggccagcagctggcctctggcaaggtactgtaccccttggagcctcagtttcctcatcagcaagtgggtataataacatattcttatcttgcagtgtctgaggatcgcatgagataaaggacttgaaagagcccagcacggggccacggacccagtgagtctatctttccttgactttgaggttgttttaaacttgagtcataagttaaatggattttggagtaagctgaataatatcatactttgtcctaaaaaaatgactctgtgttcctcatctccttccaaaaagcatgtcaggaacttataataaaaggcaataaaaccctttacgagggtagaaaataagagctgagtaataaagtgtgtatttggcagggtctcgggtgattacacacagaagccaggctaaaggaagctccagccattgaactcaaaacaggcttcagcttccagaagtcaaggcagagagagaaatgaagggtgcttcttgccggtgagcgctaaggagtgtatctggagggtctctgcgtaaggaactcgacactgcaaaccagtggaacaaggaggcagaaagcctgcgcccagctccagggagaagagtctgaggcctggagaaaacgtgccactgcctccccttgggcccagttggcccggggtcctcttggtggtgagccagcctggcttcgtcaccatggccaccttgtgaagttgcttaggggctgggcattcattcgttcgctgttctgtgcatttacatgcctgggggctgcccgtgctgagtgtggggcgatacctcttggacaaaaccattagaggtttttttggaggagatgcttgagctaggcttgaaggacaaagggtaatgatcttggggtgggagtccaggtagaggaggagatgttctgggtgcgggaagacataagagtgaaggctcagaaggtggagagccctggacatccatggtgaggctggaggtggggacatggcgtggggggtgatgagagctgcaggaggtcacggcagtgagaagagagaagaggacatgggtccgagacatggagaaggaggctcatggggacttggcgtgggcagggaagggatcgaggatgcagccaggtgtctacacagggaagcaggtggctagatgcctcctccctgtgacggggaagcccagggaagaaagctgggggagatgctggcttcggcagggcaacgtccaacctcggggacccggaggagaggatgtggctggaggcagggagaggacatggtcagtgtcacagcagtgggagactgtgggagagaggagaggagacgaccaagggagattcattcacggggcaggtg

SEQ ID NO: 405 - DNA, 8000 bp, Homo sapiens
  Locus number 17 genomic DNA region, N-acetyllactosaminide beta-1,6-N-acetylglucosaminyl-transferase, N-acetylglucosaminyltransferase, I-branching enzyme (IGNT)
agagacatgaaggcatcaaaatgggttattggattgttcccttcatacagtcacatttctagagtgtgtgtgaatatacataataaaatagtaatatatatatatacacacacttatatgtatatataaatatatttatgtgtatatatgtatatatcatatgtattatatgtatatatttaaaaatacacatgtaatatatattttaaatatgcatacaaaaatatatctcttaaagtacatataaaaaacatttataaatgcatatatgatatattcatatatgtatgtgtataaaatattttatataaaatatatttttatataatatataaaatttattatatatataattatatatatttaaatatataaaatatatataatatatactatatattaaatatataaatatatataatattactatatatttaatatatagtaatattaaatataatatatactatataatatatagtaatattaaatataatatatactataatttaatatttattatatactataataaatagtataatatttattatatactataatttaatatttattatataatatatataataaatataatatatactataatatatactataatatataatataatacatcatatattatattatacatcatatattatatatcatgtataatatatatcatatatatttaaatatatataaactatatataaaatatttatatatttatataaatatatatattttttttcccatgggctaaaggggaggcagtgatggggaagaaaagagtggaatttaacctccgggaataaagcatttgaaaaccttaaggtaaatgctttttttttccattactaagaacagaaatcaaaatatcagttcattatgagggtcagaagtgttggatattttccaaaagagaaacaacaacaacaacaatcatagctaatgcttatggaacatctaccaggtgcccggattcttgccaaaccctcaacaagaggtatctcatttagtcttgacaaccatttgaaataagagccactgttctttatcttttcacagtgggaggacctggttgtgtaaagaggttaagtaactttacccaggcactgtgagcagctgggatttagccaaacagactggcttcagcacctggaccagggagctgtggaattaaggctctggtttctatccagctgaatgacattggggagaatatttttaaaggcctcaatgtgctcatctgtaaaaataacggggttgtgatgggtgatctcaaagatccccgccaactctctagcagctcaccaaattaatatccaaatcaatatccatcgcatccacggcactgttgccattcattcctacagttcactgtaggaagttaaggggtggagtggagcagagagggggcagggaaatggctgcattgtgaatcaaatgttttcctaacaggagcagctgttccaactggcacaagccccggcaggtacgattgctaggtgactacaggagtgagatgggagcagggcccactcttaacatgcctcgtgtggctgccacagttgatcctttagttgaccagttaatttctcccttggaagtgtccttaccgtccgcatcaatccccagtgcacttcacattggctgcgagatcgcttgcagcactgcaagcaggtgaactctgagaaccctctgtaatgcgaccagacctgtgcttttcctggttcccctgaattacactggctgatacttccaggaattctgcagcagccctggtggttttgttctttcttcagaaaaggaagttggagagggggttgggtgggaaggagaatgagaatcctttaagttctttgaaatgacctcaaatctgaggttgtcaggcttttaaagagagccagtaggtagtcactccacatattgtagataatactgtgtcaacagctcaagttatctgaagctctctttgtgaaatgggacccaacttttgctctctgggaacactatcacatttctctctggcatgcaaacttaggtgtgtttgatgaagggagcctgcctctccactcctgtgggtatttcttgcaaggtggagatgagagactgagaaaagaaataagacacagagacaaagtacagaggaagaaaagtgggccctgggggaccggcgcttagtaagtgaggaccaacaccggtgctcacttactctgagtctctgagttctctcagtatttattgatcactatttttcctatcttggcgaggggaatgtggtggggctatagggtgaaggtggggagagggtcagcagaaaaacatgtgagtaaaggaatctgtgtcataaataagtttaaggaaaagtgctgggcctaaatgtacacgtaggctagatttatatttaactttacataaacatctcagtgcagtaaagagtagtattgctgccatgatgtctcacctgtatccataaggcgattttctcttagagtagaatgtatggttggttttacatttgtcattccattcccagggacgtgcgggagacagacgccttcctcttatctcaaccgcattgaggccttcttctttcactaatcctcctcagcacagaccctttacggatgtcgggctggggggctgtaaggtctttcccttcccacgaggccgtatctcaggttgtctcagtggggggaaacctggacaatacccaggctttcttgggcaggggttcctgcggccttccgcagtgcattgtgtctctagttaatagagaatggagaatggcgatgacttttacaaagcatactgcctgcaaacacatttttaccaaggcacatcctgcacagccctagatccattaaaccttgattcaatacagcacatgtttttgtgagcacaaggttgggacaaaagttacagattaacagcatctcaaagcagaacaaaatggagtttcttatgtcttctgttttctacatagacacagtaacaatctgatctctctttcttttccccacatttacttcatcatatgatatcaacactgactctttcatgtaaaatgtcagtcctaggttccttccacccttgtgtcctgcctgtgcccccaagggtgtaattctttgttccctcttcccatagtcagtgtgtgtgtgtgtgtgtgtgtgtgtgtgtgtgtgtgtgtgtgtgtgcgcgctatattctgacacatcattagaatctaaattaatctaccttgttatatttttctgccactgataatcttctacttagtcatgttacaaatgtattttttaaagtaagtgtttgaagagacagggtctcactgtcgcccaggctggagtgcagtgctgccatcatagctcactgcagccttgatctccttggctcaagcaatcctcccgcctcaacctcctgagtagctgagactacacgtgcgtgccaccatgcctggcacacattcatttttcattatctgtgtctgtatgtgcccagaggtacagataacactaaaatgaaaagaggtggcagagaacaggaagagaaagaaaccagaggagccgatatccttaaatgctgtggctcctaaggactgccagcaggttgtggggctagccagaaaaaacagagcctctgattctagaaggcttggagaaagcgtgagaagggagatcagatcagaatagattgatggaagggaaaggcggtgagggtgaagcaagagaaactcggctccagtgaaaaggacccatcattgcattccagaacgtaatttgcatttcatatgtaaatgaggaggcttcctagaggctggactgggctgggcttagctgagcctttgcaaacagcagggattcaaccctggggaactgcagaccaaagtgagagagggacgcaccgcatctccaggcacatccaaaaaggatggacgagacaccgaagcagaggatacaggaggattaaaggattcaggaaagcaagcagccctccggagaagctgtcgaaattcaagactggcaagagaagcaaattcaacctctcacaccgatcatttctcattccctgaaaagaagagattgtttccccagggaagtgaaaataatgaacttttggaggtactgcttttttgctttcactctgctcagcgtggtcatttttgtgagattttacagtagccaattgagcccgccaaaaagttatgagaagctgaacagttccagtgaaaggtattttaggaaaactgcctgtaatcacgccttagagaaaatgccagtctttttgtgggaaaatatattaccatcacctttgcgaagtgtcccttgcaaggattacctgacccagaatcactacatcacaagtcccctgtcggaagaagaggctgcattccctttggcctatgtcatggtcatccataaggactttgacacctttgaaaggctctttagggctatctatatgccccaaaatgtctactgtgttcacgtggatgagaaagccccagctgagtataaggaatctgtgaggcagttactgagttgcttccaaaatgctttcattgcttcaaagacagagtctgtggtttatgcaggcatttccagactccaggctgacctgaactgtctgaaagaccttgtcgcctctgaggttccctggaagtacgtcatcaacacctgtggacaagacttccccctgaaaaccaaccgggagatagttcagcatctgaaaggatttaaagggaaaaatatcaccccaggggtgctgcctcctgaccatgcaattaagcgaactaaatatgtccaccaagagcatacagataaaggtggcttttttgtgaaaaatactaatattttgaaaacttcacctccacatcagctgaccatctactttggcactgcctatgtggcgcttaccagagactttgtcgactttgttctacgtgaccaaagggccattgatctactacaatggtcaaaagatacctatagtcctgatgagcatttctgggtgacacttaatagggtttcaggtaggtactaatttccattctgattgatagattgagtttgctaacattctgctcgcctagagaactgactcatttgaaattattatgaaataaatttaaatacttagaaaactattagtttggttgcttgtagcaacagtgtattgctgactgttgtcttatcaatatgtgtgatatagtgatctaagaaatgctggctgcagtcgccccagcaaaactaactttgattacatagttgctgaattttaactgttgtttgaattaatacttttcgtagtccttgataaacacagctgtaacaaacaaaattgacttttaaaataagcattctagaatttaggagttgaaataggtgatgtttctttcggacggatgttagacatcgctttcattgatgcagtctcattgctcaaagttcatggagctgttacaggggtacttactggttttagaatcttggaagctgcttcggatattcacaaatcaccattctggctgaaacatctctggtttaagatctgaacaagtagccaggtctcagctcttcttgtttctacaaatctaacctgatattttagcctggaggagtgggtaacaaagagttggaacatacggagagagaatctagctacagatgatccaaagagaattctcaatttttaagtcataggtttttattggacattccaatttgcagcttcttgtttttatatactgtgcagtctttggttgtttatgataatttgggaaagcgtccaaggtatgccaggcagctgaggcagaagatagcaccaagctccctcgttggttcaggactgggtttcttttctaaactctgtttcccataggtggtctgtgacctgcgttacgtctttcctgtgtgtccccacgtgcttgttttcaacagtgacccagcatggttgtgggtgactggtggttctcatgagcacagtgaccccgacaagcctcacatacttcctgtctacacacacacactgcacaaccacaccacacatacatacacacctgcctgccattcttgaaataactcccagctcttatgtctagtgtcattatcattggcatactttcaagtgctgtttgaagccacctcttgcctgaaagtagactcaatgcagaaaggtccccaataacacggcattcctaagagctaaactagagtggtggtcacaaaaatctacttagagagggacagaaagaggatgggcaaggtggctggagacgagagaattatgctgtctcatgcgcaatttattttcagagatgctaaactgtcaggtcacaaagacttgtaggaggggtggtgaaccaacatttatcacagtggtgagagcgttaaccctttctttacaatcacctattttaaacgcatgtaaatactgcatgcgtggcatttaatcttatttttgttggtatagttggtgatagcctacatcgttccttttaatgataggaagtcatcgtgttagcctcacgtacagatgaaaaacatgaggcttagagagactgaagcaatagtatgttcacgttgttcacatagcttttcataggcaaagctggaatctgaccctgcatttgtgtggcctgaagtgtgagccgtttctcttgcactaggaaaagaaggaatgagcatttcttttttcctgtatatctaaagcaaatttcctgcagaatcccgaaaaagggaaaggattgagggtgtttggaaaaaatgaggagggctgtggaaggaagtttcacctgatcacttagagctggagatgaggttagcagggatatggtgtgtgtgtgtgtggtgtcccaatatgcttgtgtggtgtgtgtgtggtgtgtttgtagtgtgtgtgtgatgtgtgtgtgtgtgtgtgtgtgtggtgtatgtgtgtttgcagtgtatgtgtgtggtgtgtgtgtggtgtgtatgtgtatgtgtgtggggtatgtgtgtttgtagcgtgtgtgttgtgtggtgtgtgtgtagtgtgtggtgtgtttgtagtgcggtgtgtgtgtttgtagtgtgtgtggtgtgtgtgtatgtatggtgtggttgtgtggtgtgggtgtgtgtgtggtgtgtatatgtggtgtatgtgcgtggtatgtgtatggtgtgtgtgtggtgtgtgtgtagtgtgtggcgtgtttgtagtgtggtgtgtgtgtagtgtgtgtgtggtgtgtgtgtatgtgtggtgtggttatgtggtgtgggtgtgtgtgcgtgtggtgtgtgtgtggtgtatgtgcgtcatgtgtgtatggtgtgtgtggtgtgtgtgtttgcagtgtatgtatctggtgtgtgtgtggtgtgtatgtacatgtgtggggtgtgtgtgtttctagtgtgtgtggtgtgtagtgtgtggtgtgtttgtagtgtggtgtgtttgtagtgtgtgtgtagtgtgtggtgtgtttctagtgtgtgtttgtagtgtggtgtgtgtttgtagtgtgtggtgtgggtgtatgtgtggtgtgggtgtgtgcgtgtctgtgtagacagcaactatgtgaggcttgtcagggtcactgtgctcatgagagtcaccaggtgtcctttctggaaaggatccaccatccctcaaaggcttctgtgctgtctccggggtccatctggagcaggctttggtctgggccagtggcaatgggaagtggcccttggttcatgttctcagagaagctggggagtaagaagcaaccaggcagatttgaaaggtcccaaatttttaaagttttcactccatcagctaccaatgttaatacttccttgtacatctttccagaggtactttattatgtttataggtaataaaactgattaaacgtggagaacattacatatggactttaagttcactacagatatactcagaaaaggaaaaatggtccttattttaggtgccatattgtctgtgagaaacaaa

SEQ ID NO: 406 - DNA, 8000 bp, Homo sapiens
  Locus number 18 genomic DNA region, histone H3.1 (H3/a, H3/c, H3/d, H3/f, H3/h, H3/i, H3/j, H3/k, H3/l)
tagcaaattattttccggactttcttcttttcatgaaatggcattgtgcttccacagtgatttctcttcccctttttttaaacaccagaattagcagttgtagaggctgtccctcaaaaatatatgatcgaggggaaaatattcatataacatttctttttttgttgttttgttttgttttttttttttcatttttgggtcatgctctgttgcccagactgggttgcagtctcacaattatgactcactgcagcctcaaattcctagcctcaagcaatcctcctaactcagcctcctgggtcactggcattatcggactgagccactgtgcccggctaaaagaatttcaaatactgtccacttactgatattttgctatggaaaaattcaaacatcaataattttgctagttgcccacctcttcttgcgtcattgagtaatggcttaacaagcccccttagctctctaacacaactgtatagacatatagatgtagatataaatatagatattgatttattgtaaataaagtccagatgctataactgggttcatagaaatatattgaatgtactcattgtttcaaggcctatgctgtcaagatatggtaaagaatcaagaaacagagaagagaaatgaagaatcctggaacagtgctatctacaaagaataatgcaagccacggccagatgcggtggctcatgcttgtaatcccagcactttgggaggccaaggcaggtggatcacctgaggtcaggagttcaagatcagcctggccaaaatggtgaaactccccccatctccactaaaaataccaaaactacctgggtgtggtggctggtgcctgtaatcccagctactcaggaggctgaggcaggaaaatcgctggaaccggagaggcagaggttgcagtaagctaagacggcagcactgcactgcagcctgggtgacagagcaagactctgcctcaaaaaaaaaataaaaataaaaaagaataatgcaagccacatatgtaattttgaattttccagtaagcacattttaaaaattaataagcaggtaaaagaattttaataattattgtatttaaaacaaaatacaaaataattatttcaaaatatagtcaatataaaaacattattaatgcaatatttcacattcttttttaaatcttaagtcttctaaatatgagggacatcctattcaatttgatattacatttttgttggaaataaatggaatttcattttgatttcataaatttcagtgctgaaaaataaaattcatatatctgattgtttaaaacatatctaacattttccaataactgaagtatcagcctttgaattaaaataatgaaaagtaaaataaaaattcaggccgggcacagtggctcacggctataatcccagcactttgggaggccgaggtggatggattacttaaggtcaggaaatcgagaccagcctagccaacatgatgaaaccccgtttctactaaaaatacctccaccccaccccccccaaaaaaataagccgggcatggtgacaagcacctgtaactacagctactctggagactgaggcaggagaatcgcttaaactcgggaggtggagctaacagtgagctgagatcaccccactgcactccatcctgagtgacagagcaagactccttctcaaaaaaaaaagaaagtcagtcctcagcagcaacaaccacatttcaaatgctcagtagccacaactggtttctgactgttttatcacataacacagatcctatgggaaattgtgttcaggtatggaaatagtgatggaaattactgattaatacaagtgagctgctaagttcttatgtaatcatgtaaattttgcactgacttctaaaataaagctttacacatatttagagatgaggattatgaaaggaactgaaggtaggttccaatggcaaaacaccggattgacagatttaagaacactggggaggaaatagaactatggggcataaagatggaatttccttaatggttctcactgactgtgacctaaagtttatcttttgattttggaaacattttttagatgtagatattaacattctaataatagaaatgaaaaaactaaaatgaaaatgagaaaacagaagataatatcaataaacaggtcttgggcctcagaagatgagatgtagggagtgtggagaggaaaagcacagggggtgcatagctctcattaacaaacggcccagcccacaaatacgtaatcatattatacaaaaggatttcagttcttcccttgcttcctatgaaacaattttgccaacatacctaaccgttttaccgtgatttaaagtgtacagaattttctttttctgaaaaggagagaagcaagggactcatatatatttcagatgtgagattgaaacgcacgacaatgtgtaatttcagtcaagacttgcccacgagtcctaagataattcaaatttgcaaaatagacactaacttgaaaggtgcaattgtatcaatcctgtggttagcagaattttgatgaatgccctaaaatagggcaggtttaacagaattcagggaatgagcaggaatgcacaaagcatcctttgtctcctctccactccagcttgcagacatccgcgggcatttgcgggcagtgataaatttggtttagccgtttcccctccctggaggacgggggctccagcatattcatgatgtcaatcgccttggactacatgccagcgtcattgcgaacctgctacactttacaaaatagctttccaatgagaaagaaaacctactgggaaagaaaaacaaaaagaaactagaccttgcaacgggcacgcacgcgcactatccctctctgaaatatttatagtacgcttacacaaacgcgaacttgtaaatcaaaactctgcctgaaccaaagtagccaatagattaaaagtatgtaaattaggaattcccaaactgctctttttattggctaggaaaagaacaccttacagggaatccgataggttaattcacaatagtgttaggctgtaatgtcattctttaagaatcttttccagtaaacatttgttactttttcaaagtaattgggagctgttgagtgtggaagcgaaaaccaagttaagaagtcctgttatttgggtgagtccagttcctataaaagttctgttggatgtgtcttaaattgttcggtgcacctcagctctctcccgcagggatccggagaaactgcgccattgttgtcttacagagaaacaaccttctaacactctcttcgccgccatctttttcaagattttaaattgaaaatactttttttgacggctcttgccattatgtctggacgttttaatttcaacaaaacgaaataatagtgttaagttctttgagtcaaacccgatattacagaggtagggattccaggatattagaattttactataacacaaatgaaacacaaagttccttatgcttaacagtgtatcttagaaaaccttgtttgagtgaattagccttgtactctataatgaaacgaggaatcattgagagatacttaggcaacggattttaaatgagtgaataaggaagggaaaaacttcaggaaaatgcagaaaaaagcagcggagattttggaaaaaaaattctaaagcactttctaacgcaaacacattcgattttttatagctaaacaggataacagatcagtctattaagttaaatgatcaatgtctttgcaggtcatggtctacgtgaaacatcaaagaaacctgtaacggaaaacgacttgtttgaaagagccagttctctatccaaatttaccaatcagaatcttgcactgaaaaaataaaccaatcgtgaatctctacggccacttccggaatttagcaaccgatcactaacagggatcgtccacaatccaatcagagtgattctgttcctatatagaggggcaaaccaatcttcctaactcatttactttgcagatgaactatggcgcgtactaagcagacggctcgtaaatccacaggcggtaaagcaccgcgcaaacagctggccactaaggcagctcgcaagagcgctccggccacgggcggcgtgaagaagccccatcgctaccgccctggcaccgtggctctgcgcgagatccgtcgctaccagaagtctaccgagcttctaatccggaagctgccgtttcagcgcctggtgcgagaaatagctcaggacttcaagaccgacctgcgcttccagagttccgcggtgatggcgctgcaggaggcctgcgaggcctacttggtggggcttttcgaggacaccaacctgtgcgctattcatgccaaacgcgtgaccatcatgcctaaagacatccagcttgcccgccgcattcgtggggagagggcgtgaattgttttgagtacaaaccttaaatccaaaggctcttctcagagccaaccactttgtccgtgaaaagggctgtaatcctttgagacgcattagaccactaaactgcactgatccaaatagacatttgaaatagtggcattcagttccctcgatgcttcatttaaatttccaaatttaagcgctccctcaggttttcgcctagggctgggcctccctacgctgttctccattggtttagctggctttgttttgctgttcaggccctctgctgctttcttgtacattgttctcgttttctaaactcctggccacttaattgtaccctgcttaacccatcctcttgttttctggctcaacgctctttcatgtggtggcctgcattttaggtcttaactgcataggctttcaacgccttggttttgcctttccttgatgtttatttgaccttgcccgaggggccagcgcttttgatctgcatcaggctgccttactccactagtgttttgagacccagctacttgccggcgacggtcggtgccttgggtgcggtcaacgttactctctgtgcgcctgatactggtctaaggctaaggttattagctggaacacctagacccgtggcactaacacacagctcttgcagacttgacagccttgcataggttctaaactgcaggagtcaaagcaacgaaggtgcagatgggtgtgtctcaaacctgagtgcgaaaggaaaatgcagaaatcatgagccttttcaactttccagttgatatcttttgtttgcttttttcttttcttatttatttatttatttatttatttatttatttatttatttattttgagacggagtttcgcccttgttgcccaggctggagtgcattggcgcgatctcggctcaccgcaacctccgcctcccgggttcaagcgattctcctgcctcagccttccgagtagctgggattacaggcatgagccacctcgcccggccttccggctgatatcttaaaagaacttttcaactttagtaaataccctgtcttaatcaaatctcattaaaagtaccccatatttatcaacaaaacatgaaaatccttggacggcttcaaagttcttacagaaaatattctgcctttcctttccatacaaaggcacagcttcgaaactggtaggtgaagggaaggaaaataaggaattctgttacgaaatcatacaggctgttatttggaaatacagaagggtgtatgtactatatgggatactgcatgctatttggaagaattttgtttatttaaacatttcagcaaattcctcagttttgatatggggtgcagtatttttaactcattgagaaatttctactaacttttttgaatgtgctcttttcccactagttgcactaaggaaagaggttagtcatgtggtaaaattaatagtgacaaagctgtaaatagctctgcaggccaaggtagccatagtaagaagtcctggagatttatggaagaaatttttgttcatggaagcctgtcagacatgaagatgtgggtcttgtgaattggagattcagtgcgtgaggaaaacagcctaactatccataattaaggtaactactgtcagatatttgtaacatagtgaacatcctattatgctagatagaagcattctctatttgaatgttgtttcctgtatcctgtactttctttaagattctagctcaacaagttttaacctgtatttctcttacagctactggaattcagtacgtgaggacttggacttggtgggcacagaatgcatctttttatatcattaaatccaccagaacatctagcatggtcatttgcctaaaacaaagcctctggaaatttagtcaagttgagatgtaaaataaaagattactgaacagaatttaacattgagtgcattcctatttacaaaaataaaagattagataaagtttatataattttaatatatagtttttctaaataggaaaaatccacacttattgagtggctgcaatgggccagaagtcatgcagtattttatgaagcctccaaaaatgtaagttcaatagttatctattatcaaaaacaaatttaaaaactgaaactaagaaaatttcagatagtgctggagccaaaactttccccactaggcattactgttttaaataaacagcctcagcagaatcctcatcagttactcctgagggctttatcacctggaagagctactaacatgtttaaatttttcatacacaataaaataaatggatgttttaaaatttacagggtcttaggccaggcagggtggctcatgcctgtaatcccagcactttgggaggccaagccaggcagatcacctaaaatcaggagttcaagaccagcttggccaatatggataaaccccgtctctactaaaaaaatacaaaaattagccgggcatggtggcacttgcctgtaatcccagctacttgggatgctgaggcaaggagaatcacttaaacctaggaggcagaggctgcagtgaactgagactatgccactccactctaggctgggtgacaaagcaacattccatcttaaaaaaataataacaccagcctggccaacatggtgaaacaccatctctactaaaaatacaaaaattagctgggcatggtggcagacacctgtaatcccagctactcaggaggctgaggcagaagaatctttgaacctaggaggcagagctggcagtgagctgagattgcaccactgcactgtagcctgggtgacagggagagactccatctcaaataacaatactaataataagaaaatgaactttacagggtcttatatgattgtgaagttctattatattataattagtactgcaaattgcacagaaatgtaactgatgtacatacaggaaaatatgacattaacactgacaaattttagcctttctgcatactattcaaatagtagccttgatttaaccacacatacacaggcaacttttttcaaaggcatacactgagatagtagtaaataataccagatgtctttaaaataaattgtgattttatttggggaagatctcaaatctgacccctgtaagatcatactttctatgtacttgttggtacactatatagtatatatccatttcacagttacatagttgcctgcaagtacttataattaaaataaaacaagtatgtaatctctgaataaccaatagcttcttcatattataaagataatagctaaaactcaagacaattcagaaatcccattttattatttctccatactcacccgactcgacctgccaacagtaaatattgatatgtaacattttggagtttgcaaggcaacggtgaaattttttttctttgtttttattttgtagttgcccccactaaaaattgtatatatataaaatggtatacttccgaagataaggtagtctgtaaatcaggccatggaaacaagggtcatgaaaggggcagagaaatttgttactcttcttttcccacacaggaaaacagaaaatgaaaccactgaatttgatgagtatc

SEQ ID NO: 407 - DNA, 8000 bp, Homo sapiens
  Locus number 19 genomic DNA region, transcription factor CP2-like 3
tgaacaaagttgagttattagataccaaagaagaagaaaagattcttgactatcataaaccaacaaaaggaatggtttaaccataaacactgggtttctttgcacagacaatttgggacagtttggtaaaatcttttgtataattttggaaacggacttcagattaaacgattaaacacacatatttatcttcattctcccctgaaaaggatagtaaaagaacatgaagggataaatccaaaggggcaaagaagatagaggaggagtcatcagcaaaagctatatttcaacacaattctgaagaatagagagggtcgatggaggagtgaaaactagtttaacagaacagtgaaagctacactctaatatggccatagtggtcagtacagaaagagcccaattccctacaaaaccctagagtggtctgggccttggagatgacagagatcactagaagaaaatgctgatgaggggccccaggatcccggaagggtgagggagaggtgagcagctaaaagcaagaggccaggtcaatgttggcacttggagttgctggagtctcaggtgccctgtcccactcctcgcagtcagcatgagaaagaggagagaggcttgtccagcaggcacaaagaagggcaggaataaggcaactgccggaaaggaaagagtgtgaaagattgcaccctaagcagttactcatccagacctcttcccctgaactacttccagaacactggcagccaagtgaatgcctcctcaggcaagagattataagatatttctcatgagaaactgacaagccccaaagaaaagacatctagcttctgacatttgaggtatcttcccatgaaaaaatgagctttcatctgatcaccatacagcaaacccaccagtgagcaagcacatttttctcacccacatatagagtttctggtgaggtttctattacctcattcctacttatgaaaggagaggaaaaggtttgcagacagttgatgaaagcctctaacgtgatgggacgaaaacaaatacatgagaagggaagctagagaaagccaagacaaggcaggaggcaaagaaagccctacagtaagtaaatactctcaaaagatagaaaaaactagtgcgactgtgacataatcactaaattctctttataacagacagcatgaaatgagctctttaaatagttgaggtaacaactgcagtagaaagtaaagcaagaaaatatcttccaaaataggacaaaaggtgaagacatgtgcaacaggaaaaaaaaaaaaaaaaagaacattctgagattaatccagtttaaaaaataaataataagattgaataataattgagaatttaataagtgcctggtaatgttctaagtggttcagacatattagtgagataattactattataatctccattttatagatgaggaaactgaagcacagcaaaattaagtgacattctcaatagtaacactggaagctagaagataaaagagcaatttttgcctgtaatcccagctacctgggaagttgagtcaggaggatcacttgagtccaggattttgaggctgcagagagctatgaccatgtcactgcactccaggtggtgtgacagagtaagaacttgtttttaaaaatttaattaattaatttttttagagacaaggttttgctctgtagcccaggctggagtgcagtgtcatgatcttgactcactgcagccttgacctccctggggtcaggcaatctcctctcctcagccccctgagtagccgggactacaggtgcacaccagtatgcctggttaatttttgtattttttgtagagatggggtctagctacattgcccatgctgatcttgaactcctggactcaagtgatcctcctgccttggcctcccaaagtgctgggattacaggtgcaagccactgtgcatggcctaaaaattttttttaattaaaaaattaaaataaataagtgaaaagcaatttctataaaattatgaatgaagaaattctggtaagaattctacacttggtcaaactctagtaaaagtaaaagttgaataaagacatattcaagtatgtaataactcaaatttttaccttctgtaccctttcttgggctgttactaaaacatgtgccatggaaaatgaagcagtaaaccaagaaagaaggcacaaaacacagaaatgggggttctcacactacagattaaggagtgtcccaggccgggcacggtggctcacacctgtaatcccagcactttgggaggctgaggcaggtggatcacctgaggttgggagttctagaccagcctgaccaacatggagaaaccccgtctctactaaaaatacaaaattagctggacttggtggtgcatgcctgtaatcccagctacttgggaggctgaggcaggagaatcacttgaacccgggaggcagaggttgtagtgagctgagatcacaccgttgcacactagcctgggcaacagagagagactctgtcaaaaaaaaaaaaaaaaaaaaaaaaagagtgtcccaggatgacacttgagaagcggatccatagagcaactcatctccactgaaacagtagaacaatgaatttctggaggaattgttttcagggcaaaattggaattgattgtttgatcatttggaaaataaacatgatagtcatttgatagatcagttgtagaaaaatatcaggatggggcataacaaactaagtaaatagatacaaggttttataaggaagaaaacaagaatagtacactattggctgtgttgtcattgctattggcatagtcacttacttagctcctaaactgtgaaagtgctgtgttggaaggagaagttgcttggcatgaaagagctaaatcctaatctgaagcaacaggtagtcagagcacaacatctattggcaaatcaagagatggcagtacaaattatttagaaatagggaggtaaatgacagaagagacagataaaagcagaatatggctgcctctaaaaaggagaggaacatgataggtattgcattatcttaaaatattatattaaaatagtacctgcattgtcttaaaatatattatttctttaaagtgtgtgtttatattgttttttaaaaatacaattttgaaatttattgttgaaaatggacacatggaacaaaccaaaccttgttttatcatgtaattttcagaaaatatgtgatccataaagattaaaagaaagttgtattaagtctggcagctttagtattaacttgaaataaaatatggcaagctttccacgtcctcctttatttccacaatccatatgtacgagctagattccagtcagaacttccacaaatacttcactctttggtagcagcggttataaattacgcctttgctaatttgcgttgttcccaaccaggagaaacattaccacaaaaaaagtcagtttcatcctgcagtgttcccgcagcaaccatattaagctggaagaataaagctcctttgtagtagtagcgtctattgaattacaatgtaaatgttgatgcctgcctggaaacgtcaaatgacaacaggtttacagaacgaattcagtggttgtttgcagctctggaatcccaggctgcagagttgagatcgaagaggtgcgtctggccatcttagcgttcattcaaccaaatctcctcactccatcaaaaccacgccactccccacctgcccagctcgtaaaaggatgctcacctgtttgaaaatctgtaatatatctgatgtcttttacacagcaggacacgaaaaagtgtttgttgtggataagagtgttaaaaattcaattacgcaacagaccaaactttgtgcttctttccccctctcagcacaaagtaactttagtcccgtcctcttctgccactgtcaaacagccctgttactgtgggcattaaatgccttgtggcgtactgcgcatttgattctggttgacttgggatacctgagctcggctctcattagctcttccgctcgacccacaatccctagtgtttgcaggtgttgcattcccccaacccctttcttctcttcaaccagtagcctccaccttcccatccctgctttggagaaggaggaaaacgcagcttgagatctactcgaagaactgaccctcagctctcacaggctgccgccgagctgcaagcatgccgccgctccactcgggtaaacttcggagtgagttacctgcactcggagaagggccttacctgagcgcgcctctgccaatggcagctcacctgagggagctccccagccaatcatcgcgcagctcgtccctcgggcttgtaccctttagtgaaagaattcagctccttgcgagaaagttacctgtggccgcccaagtccgccactttctgctctgtgtctgcccattgccacgatccaggaggactccgcgccgcccggccgcctccgagctcgggccccatgtgaggggcccccccttatcccacctttccggctaggtgagggcgcgagcgggcgagcgagcgagagtggtgaggggggacggaaaagcagaattacctgtagctcttgttctgccatctcgggcgctctcacacaccttcacctgcacagacttgaaagtccagtttcaccagaggctgaggctccaggaaaagcggagcaagttcattggatcaaacatgtcacaagagtcggacaagtaagtggatcacacgcgccggctgctgctactactaccactttgggctgatggcaactggtttgttatgtttttgtttttaagttgctattgttggtatttttctttcttttttctttttctttttggtggatccagacttttccgcattatgtttctaccctgattaaggggagaaaccctacaacaatgtgaatatttaatatcccctttgggccttgatagtaaaagtgggttttccttttccttcttcccttaggaatggtctcagctcccgctcctggatgaatacttggatattgccagaggttttggtagatgggcgcgggaggcctgctcttccctctctgttttagctgctcccaccgatctggcgtttagggccatttggaagttcagctgagttccttcgatttgtccaaagggcctactggaaaagtggggcttggccgcttttgtgtgaccgcaacaaagagcttttatatgaggcagaaacggccatcttctcgcaccgggcaggagggtgggcgtgagtgcgcgcccgcgtgtggccccgatgggaggcgaggcgctgggaggccggggggcgcgggggcggccggcgccgtcccccactccctcgacatcccgccttcctcccccctcccccgcctccctcccccgggtccgcccccgcattgtttggccaccttcctcaggtgcccggggggaaaggacggttcgcgaactgggggaactcatgtgaggcctcgagttagggcctcggcggggcgcgaaggggcgcctgccactgagcgattcacccgcgcccccgacggcgtctgcacgcccctcgagctcgcggccctccacgcagttggccgccacctcggacgcggcaggcgggactgcgtggggcgcgccgagccttctcggggtgctctcgccgtcaaggccgagggctcggggcggcgggaacgctgggctcgcgtccttcccgtcccggacaggcactccagacgcgtcggggagccacagcctgcgcggccggagccgcccgcgggtcactgggcccggtccggccgcgtcctgacggcctcccccctggccggcccccgccctcggaaggctttgtgcgagccgggggaggtggggcctgggcgggcgcgggagggagccggaggtgggtcccgcggcctttctcgggattcggcggggacactcccttccccctcctctcgggcgcgtccgggcctgggaactggctgcgtcctattggaagtgcgcggggccgcccttttgctttccccggtaactttgccgtggcgttgcggccaccccgaggggaccttcctgaaggtgtctcgccggagagggccggtgccccaaggccgcgggccgctgggcctgtcatggagaagtggcggggacccgtcccaagttgagggaccacgagggaggagtgggaaggccctgcggacctgttcaggggtggaggggaaggactagcctcaacataaagccgctggcaggttaggcgaacctaagaaaatgcgctgtcatacttaaaaagcaaaaaactgccagatagttgtaccccgttagccaccgatgaggaattaaccgagtacagcataccggaggggaagaactagcgttaccaacacgggagcgggtcagaggcagggtaggaagaggagagtgtgtggttgtctgagaacacccccagctcctccccatatctctctagtcttcaaggaaacacgactcgagtttgaaattttcagtagccaaatccggaggcgacagcaagtttttggggtttgttttgatctttgcctgcgtcaaagatgattgcaaatctaatttaattaatcgcgcaattaacatttagtttgcttagttttgtgatacaacagaactcgaattctgaatgaaaacgggtcggtctttattttcaccagttatacttagcagcaataagaacaatgtgtttaccatcagaaataagtactgagcgcccgcaatctggtttcaccacacgcatcacctggtttttacaggtgataagtatctgggattacatatgcttgcatttaatgaacgttgcttttatctagtcgtggtttccaagacgaaattttgtatcctgggaaaagtaatcgttacaatggtgcaaggagataattcaactggtttgtttctctctcattgggctgttgaaaatgctttaagtcaatacatgacttctggatcatttttgcgaattctagcctcgttttcttaatattctaagggagccccggcaggggtgggtctgaagcttatgcaactatgtgtgtgacatggggtggggactgtaagtaaacgggcccctgggtacagcgtggggcttccttcctgagcaagtgagaggcttcatcagcctcatggaaaatccaccttacgaggcctgcctgtagtttctggaaataacatgaacgaacacacactggatgttctttcataatcccattgagatttaggcaatctttgggattgcacaggaagatatttctggttaacaagtctggactgaagtagcatcgtcttttttatggtgtggacttttcagattgaaacgttctgcttttgatgttctgcagtgttgatgctatcgccaattaaaacaaagtatttttaggacattttgtctttgtacatattttaaaattctctactccatcttaaattttatgaagatttaagatctttgtcagcaagcatgtgtacaagtgaagcaatgctagattaagaaactcttattttactgccaaaatgtataaaatatatttagagaacgtgtaggtactatgtgatttgatactcacaggtgtttttcattaggtaagtgtattttctggttacctactatttgtaacacattcagataggcgtaatagaggcatgcgaagatggataagatgagccctgttctcagggggcttacactgtagtggaaagcaactcatggacagacatacttctaataaacacaatgcttaatagtcacaaaaaatacaacagttacaaaaatgtttttaaaaatacaatacaggggccaggcgcggcggctcacacctgtaatcccagcactttggcaggccgaggcaggtggatcacgaggtcaggagttcatgaccagcctgatcaacatagtgaaaccctgtctctactaaatatacaaaaaattagccaggtgtggtggcaggtgcctgtaatctcagctacttgggaggctgaggcaggagaatcccttga

SEQ ID NO: 408 - DNA, 8000 bp, Homo sapiens
  Locus number 20 genomic DNA region, transcription factor CP2-like 3
ttccctacaaaaccctagagtggtctgggccttggagatgacagagatcactagaagaaaatgctgatgaggggccccaggatcccggaagggtgagggagaggtgagcagctaaaagcaagaggccaggtcaatgttggcacttggagttgctggagtctcaggtgccctgtcccactcctcgcagtcagcatgagaaagaggagagaggcttgtccagcaggcacaaagaagggcaggaataaggcaactgccggaaaggaaagagtgtgaaagattgcaccctaagcagttactcatccagacctcttcccctgaactacttccagaacactggcagccaagtgaatgcctcctcaggcaagagattataagatatttctcatgagaaactgacaagccccaaagaaaagacatctagcttctgacatttgaggtatcttcccatgaaaaaatgagctttcatctgatcaccatacagcaaacccaccagtgagcaagcacatttttctcacccacatatagagtttctggtgaggtttctattacctcattcctacttatgaaaggagaggaaaaggtttgcagacagttgatgaaagcctctaacgtgatgggacgaaaacaaatacatgagaagggaagctagagaaagccaagacaaggcaggaggcaaagaaagccctacagtaagtaaatactctcaaaagatagaaaaaactagtgcgactgtgacataatcactaaattctctttataacagacagcatgaaatgagctctttaaatagttgaggtaacaactgcagtagaaagtaaagcaagaaaatatcttccaaaataggacaaaaggtgaagacatgtgcaacaggaaaaaaaaaaaaaaaaagaacattctgagattaatccagtttaaaaaataaataataagattgaataataattgagaatttaataagtgcctggtaatgttctaagtggttcagacatattagtgagataattactattataatctccattttatagatgaggaaactgaagcacagcaaaattaagtgacattctcaatagtaacactggaagctagaagataaaagagcaatttttgcctgtaatcccagctacctgggaagttgagtcaggaggatcacttgagtccaggattttgaggctgcagagagctatgaccatgtcactgcactccaggtggtgtgacagagtaagaacttgtttttaaaaatttaattaattaatttttttagagacaaggttttgctctgtagcccaggctggagtgcagtgtcatgatcttgactcactgcagccttgacctccctggggtcaggcaatctcctctcctcagccccctgagtagccgggactacaggtgcacaccagtatgcctggttaatttttgtattttttgtagagatggggtctagctacattgcccatgctgatcttgaactcctggactcaagtgatcctcctgccttggcctcccaaagtgctgggattacaggtgcaagccactgtgcatggcctaaaaattttttttaattaaaaaattaaaataaataagtgaaaagcaatttctataaaattatgaatgaagaaattctggtaagaattctacacttggtcaaactctagtaaaagtaaaagttgaataaagacatattcaagtatgtaataactcaaatttttaccttctgtaccctttcttgggctgttactaaaacatgtgccatggaaaatgaagcagtaaaccaagaaagaaggcacaaaacacagaaatgggggttctcacactacagattaaggagtgtcccaggccgggcacggtggctcacacctgtaatcccagcactttgggaggctgaggcaggtggatcacctgaggttgggagttctagaccagcctgaccaacatggagaaaccccgtctctactaaaaatacaaaattagctggacttggtggtgcatgcctgtaatcccagctacttgggaggctgaggcaggagaatcacttgaacccgggaggcagaggttgtagtgagctgagatcacaccgttgcacactagcctgggcaacagagagagactctgtcaaaaaaaaaaaaaaaaaaaaaaaaagagtgtcccaggatgacacttgagaagcggatccatagagcaactcatctccactgaaacagtagaacaatgaatttctggaggaattgttttcagggcaaaattggaattgattgtttgatcatttggaaaataaacatgatagtcatttgatagatcagttgtagaaaaatatcaggatggggcataacaaactaagtaaatagatacaaggttttataaggaagaaaacaagaatagtacactattggctgtgttgtcattgctattggcatagtcacttacttagctcctaaactgtgaaagtgctgtgttggaaggagaagttgcttggcatgaaagagctaaatcctaatctgaagcaacaggtagtcagagcacaacatctattggcaaatcaagagatggcagtacaaattatttagaaatagggaggtaaatgacagaagagacagataaaagcagaatatggctgcctctaaaaaggagaggaacatgataggtattgcattatcttaaaatattatattaaaatagtacctgcattgtcttaaaatatattatttctttaaagtgtgtgtttatattgttttttaaaaatacaattttgaaatttattgttgaaaatggacacatggaacaaaccaaaccttgttttatcatgtaattttcagaaaatatgtgatccataaagattaaaagaaagttgtattaagtctggcagctttagtattaacttgaaataaaatatggcaagctttccacgtcctcctttatttccacaatccatatgtacgagctagattccagtcagaacttccacaaatacttcactctttggtagcagcggttataaattacgcctttgctaatttgcgttgttcccaaccaggagaaacattaccacaaaaaaagtcagtttcatcctgcagtgttcccgcagcaaccatattaagctggaagaataaagctcctttgtagtagtagcgtctattgaattacaatgtaaatgttgatgcctgcctggaaacgtcaaatgacaacaggtttacagaacgaattcagtggttgtttgcagctctggaatcccaggctgcagagttgagatcgaagaggtgcgtctggccatcttagcgttcattcaaccaaatctcctcactccatcaaaaccacgccactccccacctgcccagctcgtaaaaggatgctcacctgtttgaaaatctgtaatatatctgatgtcttttacacagcaggacacgaaaaagtgtttgttgtggataagagtgttaaaaattcaattacgcaacagaccaaactttgtgcttctttccccctctcagcacaaagtaactttagtcccgtcctcttctgccactgtcaaacagccctgttactgtgggcattaaatgccttgtggcgtactgcgcatttgattctggttgacttgggatacctgagctcggctctcattagctcttccgctcgacccacaatccctagtgtttgcaggtgttgcattcccccaacccctttcttctcttcaaccagtagcctccaccttcccatccctgctttggagaaggaggaaaacgcagcttgagatctactcgaagaactgaccctcagctctcacaggctgccgccgagctgcaagcatgccgccgctccactcgggtaaacttcggagtgagttacctgcactcggagaagggccttacctgagcgcgcctctgccaatggcagctcacctgagggagctccccagccaatcatcgcgcagctcgtccctcgggcttgtaccctttagtgaaagaattcagctccttgcgagaaagttacctgtggccgcccaagtccgccactttctgctctgtgtctgcccattgccacgatccaggaggactccgcgccgcccggccgcctccgagctcgggccccatgtgaggggcccccccttatcccacctttccggctaggtgagggcgcgagcgggcgagcgagcgagagtggtgaggggggacggaaaagcagaattacctgtagctcttgttctgccatctcgggcgctctcacacaccttcacctgcacagacttgaaagtccagtttcaccagaggctgaggctccaggaaaagcggagcaagttcattggatcaaacatgtcacaagagtcggacaagtaagtggatcacacgcgccggctgctgctactactaccactttgggctgatggcaactggtttgttatgtttttgtttttaagttgctattgttggtatttttctttcttttttctttttctttttggtggatccagacttttccgcattatgtttctaccctgattaaggggagaaaccctacaacaatgtgaatatttaatatcccctttgggccttgatagtaaaagtgggttttccttttccttcttcccttaggaatggtctcagctcccgctcctggatgaatacttggatattgccagaggttttggtagatgggcgcgggaggcctgctcttccctctctgttttagctgctcccaccgatctggcgtttagggccatttggaagttcagctgagttccttcgatttgtccaaagggcctactggaaaagtggggcttggccgcttttgtgtgaccgcaacaaagagcttttatatgaggcagaaacggccatcttctcgcaccgggcaggagggtgggcgtgagtgcgcgcccgcgtgtggccccgatgggaggcgaggcgctgggaggccggggggcgcgggggcggccggcgccgtcccccactccctcgacatcccgccttcctcccccctcccccgcctccctcccccgggtccgcccccgcattgtttggccaccttcctcaggtgcccggggggaaaggacggttcgcgaactgggggaactcatgtgaggcctcgagttagggcctcggcggggcgcgaaggggcgcctgccactgagcgattcacccgcgcccccgacggcgtctgcacgcccctcgagctcgcggccctccacgcagttggccgccacctcggacgcggcaggcgggactgcgtggggcgcgccgagccttctcggggtgctctcgccgtcaaggccgagggctcggggcggcgggaacgctgggctcgcgtccttcccgtcccggacaggcactccagacgcgtcggggagccacagcctgcgcggccggagccgcccgcgggtcactgggcccggtccggccgcgtcctgacggcctcccccctggccggcccccgccctcggaaggctttgtgcgagccgggggaggtggggcctgggcgggcgcgggagggagccggaggtgggtcccgcggcctttctcgggattcggcggggacactcccttccccctcctctcgggcgcgtccgggcctgggaactggctgcgtcctattggaagtgcgcggggccgcccttttgctttccccggtaactttgccgtggcgttgcggccaccccgaggggaccttcctgaaggtgtctcgccggagagggccggtgccccaaggccgcgggccgctgggcctgtcatggagaagtggcggggacccgtcccaagttgagggaccacgagggaggagtgggaaggccctgcggacctgttcaggggtggaggggaaggactagcctcaacataaagccgctggcaggttaggcgaacctaagaaaatgcgctgtcatacttaaaaagcaaaaaactgccagatagttgtaccccgttagccaccgatgaggaattaaccgagtacagcataccggaggggaagaactagcgttaccaacacgggagcgggtcagaggcagggtaggaagaggagagtgtgtggttgtctgagaacacccccagctcctccccatatctctctagtcttcaaggaaacacgactcgagtttgaaattttcagtagccaaatccggaggcgacagcaagtttttggggtttgttttgatctttgcctgcgtcaaagatgattgcaaatctaatttaattaatcgcgcaattaacatttagtttgcttagttttgtgatacaacagaactcgaattctgaatgaaaacgggtcggtctttattttcaccagttatacttagcagcaataagaacaatgtgtttaccatcagaaataagtactgagcgcccgcaatctggtttcaccacacgcatcacctggtttttacaggtgataagtatctgggattacatatgcttgcatttaatgaacgttgcttttatctagtcgtggtttccaagacgaaattttgtatcctgggaaaagtaatcgttacaatggtgcaaggagataattcaactggtttgtttctctctcattgggctgttgaaaatgctttaagtcaatacatgacttctggatcatttttgcgaattctagcctcgttttcttaatattctaagggagccccggcaggggtgggtctgaagcttatgcaactatgtgtgtgacatggggtggggactgtaagtaaacgggcccctgggtacagcgtggggcttccttcctgagcaagtgagaggcttcatcagcctcatggaaaatccaccttacgaggcctgcctgtagtttctggaaataacatgaacgaacacacactggatgttctttcataatcccattgagatttaggcaatctttgggattgcacaggaagatatttctggttaacaagtctggactgaagtagcatcgtcttttttatggtgtggacttttcagattgaaacgttctgcttttgatgttctgcagtgttgatgctatcgccaattaaaacaaagtatttttaggacattttgtctttgtacatattttaaaattctctactccatcttaaattttatgaagatttaagatctttgtcagcaagcatgtgtacaagtgaagcaatgctagattaagaaactcttattttactgccaaaatgtataaaatatatttagagaacgtgtaggtactatgtgatttgatactcacaggtgtttttcattaggtaagtgtattttctggttacctactatttgtaacacattcagataggcgtaatagaggcatgcgaagatggataagatgagccctgttctcagggggcttacactgtagtggaaagcaactcatggacagacatacttctaataaacacaatgcttaatagtcacaaaaaatacaacagttacaaaaatgtttttaaaaatacaatacaggggccaggcgcggcggctcacacctgtaatcccagcactttggcaggccgaggcaggtggatcacgaggtcaggagttcatgaccagcctgatcaacatagtgaaaccctgtctctactaaatatacaaaaaattagccaggtgtggtggcaggtgcctgtaatctcagctacttgggaggctgaggcaggagaatcccttgaacctgggaggcgggggttgcagtgagctgagatcacaccactgcactccagcctgggtgacagtgcgagactccatctcaaaaaaaaaaaaaaaaaatacaggtcatgataaactgcctctccctactcatcgcatttttgcttatgataatttcagtcattttgtgtgttttttgttaaggagtcctgctattattcagaaaatggctgaagttataggtctctcatgtggataacatttcaagtaatgggatgactctacattttaattaaactctctagtctttagttttataaatgcatatgcttgtttacatttggctatgcaaaatttcttttaaggttagaaacgtcaagaatttatcatatctttttcaaaccaatacatatacccattcac

SEQ ID NO: 409 - DNA, 8000 bp, Homo sapiens
  Locus number 21 genomic DNA region, transcription factor CP2-like 3
ccagacctcttcccctgaactacttccagaacactggcagccaagtgaatgcctcctcaggcaagagattataagatatttctcatgagaaactgacaagccccaaagaaaagacatctagcttctgacatttgaggtatcttcccatgaaaaaatgagctttcatctgatcaccatacagcaaacccaccagtgagcaagcacatttttctcacccacatatagagtttctggtgaggtttctattacctcattcctacttatgaaaggagaggaaaaggtttgcagacagttgatgaaagcctctaacgtgatgggacgaaaacaaatacatgagaagggaagctagagaaagccaagacaaggcaggaggcaaagaaagccctacagtaagtaaatactctcaaaagatagaaaaaactagtgcgactgtgacataatcactaaattctctttataacagacagcatgaaatgagctctttaaatagttgaggtaacaactgcagtagaaagtaaagcaagaaaatatcttccaaaataggacaaaaggtgaagacatgtgcaacaggaaaaaaaaaaaaaaaaagaacattctgagattaatccagtttaaaaaataaataataagattgaataataattgagaatttaataagtgcctggtaatgttctaagtggttcagacatattagtgagataattactattataatctccattttatagatgaggaaactgaagcacagcaaaattaagtgacattctcaatagtaacactggaagctagaagataaaagagcaatttttgcctgtaatcccagctacctgggaagttgagtcaggaggatcacttgagtccaggattttgaggctgcagagagctatgaccatgtcactgcactccaggtggtgtgacagagtaagaacttgtttttaaaaatttaattaattaatttttttagagacaaggttttgctctgtagcccaggctggagtgcagtgtcatgatcttgactcactgcagccttgacctccctggggtcaggcaatctcctctcctcagccccctgagtagccgggactacaggtgcacaccagtatgcctggttaatttttgtattttttgtagagatggggtctagctacattgcccatgctgatcttgaactcctggactcaagtgatcctcctgccttggcctcccaaagtgctgggattacaggtgcaagccactgtgcatggcctaaaaattttttttaattaaaaaattaaaataaataagtgaaaagcaatttctataaaattatgaatgaagaaattctggtaagaattctacacttggtcaaactctagtaaaagtaaaagttgaataaagacatattcaagtatgtaataactcaaatttttaccttctgtaccctttcttgggctgttactaaaacatgtgccatggaaaatgaagcagtaaaccaagaaagaaggcacaaaacacagaaatgggggttctcacactacagattaaggagtgtcccaggccgggcacggtggctcacacctgtaatcccagcactttgggaggctgaggcaggtggatcacctgaggttgggagttctagaccagcctgaccaacatggagaaaccccgtctctactaaaaatacaaaattagctggacttggtggtgcatgcctgtaatcccagctacttgggaggctgaggcaggagaatcacttgaacccgggaggcagaggttgtagtgagctgagatcacaccgttgcacactagcctgggcaacagagagagactctgtcaaaaaaaaaaaaaaaaaaaaaaaaagagtgtcccaggatgacacttgagaagcggatccatagagcaactcatctccactgaaacagtagaacaatgaatttctggaggaattgttttcagggcaaaattggaattgattgtttgatcatttggaaaataaacatgatagtcatttgatagatcagttgtagaaaaatatcaggatggggcataacaaactaagtaaatagatacaaggttttataaggaagaaaacaagaatagtacactattggctgtgttgtcattgctattggcatagtcacttacttagctcctaaactgtgaaagtgctgtgttggaaggagaagttgcttggcatgaaagagctaaatcctaatctgaagcaacaggtagtcagagcacaacatctattggcaaatcaagagatggcagtacaaattatttagaaatagggaggtaaatgacagaagagacagataaaagcagaatatggctgcctctaaaaaggagaggaacatgataggtattgcattatcttaaaatattatattaaaatagtacctgcattgtcttaaaatatattatttctttaaagtgtgtgtttatattgttttttaaaaatacaattttgaaatttattgttgaaaatggacacatggaacaaaccaaaccttgttttatcatgtaattttcagaaaatatgtgatccataaagattaaaagaaagttgtattaagtctggcagctttagtattaacttgaaataaaatatggcaagctttccacgtcctcctttatttccacaatccatatgtacgagctagattccagtcagaacttccacaaatacttcactctttggtagcagcggttataaattacgcctttgctaatttgcgttgttcccaaccaggagaaacattaccacaaaaaaagtcagtttcatcctgcagtgttcccgcagcaaccatattaagctggaagaataaagctcctttgtagtagtagcgtctattgaattacaatgtaaatgttgatgcctgcctggaaacgtcaaatgacaacaggtttacagaacgaattcagtggttgtttgcagctctggaatcccaggctgcagagttgagatcgaagaggtgcgtctggccatcttagcgttcattcaaccaaatctcctcactccatcaaaaccacgccactccccacctgcccagctcgtaaaaggatgctcacctgtttgaaaatctgtaatatatctgatgtcttttacacagcaggacacgaaaaagtgtttgttgtggataagagtgttaaaaattcaattacgcaacagaccaaactttgtgcttctttccccctctcagcacaaagtaactttagtcccgtcctcttctgccactgtcaaacagccctgttactgtgggcattaaatgccttgtggcgtactgcgcatttgattctggttgacttgggatacctgagctcggctctcattagctcttccgctcgacccacaatccctagtgtttgcaggtgttgcattcccccaacccctttcttctcttcaaccagtagcctccaccttcccatccctgctttggagaaggaggaaaacgcagcttgagatctactcgaagaactgaccctcagctctcacaggctgccgccgagctgcaagcatgccgccgctccactcgggtaaacttcggagtgagttacctgcactcggagaagggccttacctgagcgcgcctctgccaatggcagctcacctgagggagctccccagccaatcatcgcgcagctcgtccctcgggcttgtaccctttagtgaaagaattcagctccttgcgagaaagttacctgtggccgcccaagtccgccactttctgctctgtgtctgcccattgccacgatccaggaggactccgcgccgcccggccgcctccgagctcgggccccatgtgaggggcccccccttatcccacctttccggctaggtgagggcgcgagcgggcgagcgagcgagagtggtgaggggggacggaaaagcagaattacctgtagctcttgttctgccatctcgggcgctctcacacaccttcacctgcacagacttgaaagtccagtttcaccagaggctgaggctccaggaaaagcggagcaagttcattggatcaaacatgtcacaagagtcggacaagtaagtggatcacacgcgccggctgctgctactactaccactttgggctgatggcaactggtttgttatgtttttgtttttaagttgctattgttggtatttttctttcttttttctttttctttttggtggatccagacttttccgcattatgtttctaccctgattaaggggagaaaccctacaacaatgtgaatatttaatatcccctttgggccttgatagtaaaagtgggttttccttttccttcttcccttaggaatggtctcagctcccgctcctggatgaatacttggatattgccagaggttttggtagatgggcgcgggaggcctgctcttccctctctgttttagctgctcccaccgatctggcgtttagggccatttggaagttcagctgagttccttcgatttgtccaaagggcctactggaaaagtggggcttggccgcttttgtgtgaccgcaacaaagagcttttatatgaggcagaaacggccatcttctcgcaccgggcaggagggtgggcgtgagtgcgcgcccgcgtgtggccccgatgggaggcgaggcgctgggaggccggggggcgcgggggcggccggcgccgtcccccactccctcgacatcccgccttcctcccccctcccccgcctccctcccccgggtccgcccccgcattgtttggccaccttcctcaggtgcccggggggaaaggacggttcgcgaactgggggaactcatgtgaggcctcgagttagggcctcggcggggcgcgaaggggcgcctgccactgagcgattcacccgcgcccccgacggcgtctgcacgcccctcgagctcgcggccctccacgcagttggccgccacctcggacgcggcaggcgggactgcgtggggcgcgccgagccttctcggggtgctctcgccgtcaaggccgagggctcggggcggcgggaacgctgggctcgcgtccttcccgtcccggacaggcactccagacgcgtcggggagccacagcctgcgcggccggagccgcccgcgggtcactgggcccggtccggccgcgtcctgacggcctcccccctggccggcccccgccctcggaaggctttgtgcgagccgggggaggtggggcctgggcgggcgcgggagggagccggaggtgggtcccgcggcctttctcgggattcggcggggacactcccttccccctcctctcgggcgcgtccgggcctgggaactggctgcgtcctattggaagtgcgcggggccgcccttttgctttccccggtaactttgccgtggcgttgcggccaccccgaggggaccttcctgaaggtgtctcgccggagagggccggtgccccaaggccgcgggccgctgggcctgtcatggagaagtggcggggacccgtcccaagttgagggaccacgagggaggagtgggaaggccctgcggacctgttcaggggtggaggggaaggactagcctcaacataaagccgctggcaggttaggcgaacctaagaaaatgcgctgtcatacttaaaaagcaaaaaactgccagatagttgtaccccgttagccaccgatgaggaattaaccgagtacagcataccggaggggaagaactagcgttaccaacacgggagcgggtcagaggcagggtaggaagaggagagtgtgtggttgtctgagaacacccccagctcctccccatatctctctagtcttcaaggaaacacgactcgagtttgaaattttcagtagccaaatccggaggcgacagcaagtttttggggtttgttttgatctttgcctgcgtcaaagatgattgcaaatctaatttaattaatcgcgcaattaacatttagtttgcttagttttgtgatacaacagaactcgaattctgaatgaaaacgggtcggtctttattttcaccagttatacttagcagcaataagaacaatgtgtttaccatcagaaataagtactgagcgcccgcaatctggtttcaccacacgcatcacctggtttttacaggtgataagtatctgggattacatatgcttgcatttaatgaacgttgcttttatctagtcgtggtttccaagacgaaattttgtatcctgggaaaagtaatcgttacaatggtgcaaggagataattcaactggtttgtttctctctcattgggctgttgaaaatgctttaagtcaatacatgacttctggatcatttttgcgaattctagcctcgttttcttaatattctaagggagccccggcaggggtgggtctgaagcttatgcaactatgtgtgtgacatggggtggggactgtaagtaaacgggcccctgggtacagcgtggggcttccttcctgagcaagtgagaggcttcatcagcctcatggaaaatccaccttacgaggcctgcctgtagtttctggaaataacatgaacgaacacacactggatgttctttcataatcccattgagatttaggcaatctttgggattgcacaggaagatatttctggttaacaagtctggactgaagtagcatcgtcttttttatggtgtggacttttcagattgaaacgttctgcttttgatgttctgcagtgttgatgctatcgccaattaaaacaaagtatttttaggacattttgtctttgtacatattttaaaattctctactccatcttaaattttatgaagatttaagatctttgtcagcaagcatgtgtacaagtgaagcaatgctagattaagaaactcttattttactgccaaaatgtataaaatatatttagagaacgtgtaggtactatgtgatttgatactcacaggtgtttttcattaggtaagtgtattttctggttacctactatttgtaacacattcagataggcgtaatagaggcatgcgaagatggataagatgagccctgttctcagggggcttacactgtagtggaaagcaactcatggacagacatacttctaataaacacaatgcttaatagtcacaaaaaatacaacagttacaaaaatgtttttaaaaatacaatacaggggccaggcgcggcggctcacacctgtaatcccagcactttggcaggccgaggcaggtggatcacgaggtcaggagttcatgaccagcctgatcaacatagtgaaaccctgtctctactaaatatacaaaaaattagccaggtgtggtggcaggtgcctgtaatctcagctacttgggaggctgaggcaggagaatcccttgaacctgggaggcgggggttgcagtgagctgagatcacaccactgcactccagcctgggtgacagtgcgagactccatctcaaaaaaaaaaaaaaaaaatacaggtcatgataaactgcctctccctactcatcgcatttttgcttatgataatttcagtcattttgtgtgttttttgttaaggagtcctgctattattcagaaaatggctgaagttataggtctctcatgtggataacatttcaagtaatgggatgactctacattttaattaaactctctagtctttagttttataaatgcatatgcttgtttacatttggctatgcaaaatttcttttaaggttagaaacgtcaagaatttatcatatctttttcaaaccaatacatatacccattcactttttgaaagaatatgccttgaatgccactatatacttggcattgagattcactggtgaatagaacttagtccctgcctgcatggtgcttactgtgtgtgtgttgggggtgggggaaaaggggcaggcttgttgacactaaatcaacaaaaaagtaaacatatatttaattagatgatgataagtgctatgaaggaaagcaaaaccagctggagggattgagaataatggggaggtcttttgtatagggtgatcatggacagcttctccaatgaggtgagctttgagtggaggcctgagt

SEQ ID NO: 410 - DNA, 8000 bp, Homo sapiens
  Locus number 22 genomic DNA region, forkhead box protein D4, forkhead-related protein FKHL9, forkhead- related transcription factor 5 (FREAC-5), myeloid factor-alpha
tggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggaggacccggtgcctggacgacccggagcaggggaagcactcggccgacgctgtcgctgtcatcggcgtcattggcgggcaggacagtggggcgggtaaggggcctccccgcgcctcccggcccttcgcgctcggcgccagctctttggctcccttccctgcgcagctctaggcttagctctcagccatttctcaagaagacgatcccgagggtcgaaggccgcccttgacccttgaccacggactctccgtgtaactcggaagagccgtgattttaaaacccggcctcggggttacagaagcccgagatctgggaggcgtccgggacctccctcccagaaccgcagggacccggcctgggatccagggtgtggcctctcgctctgcgcggtcgggaaggcggccgggtccggtcaccgcgccaagcactgcgcacccctgggacgcgtcgttgcggggggctggggggctggggcgcctccacgacgcctggtctgcccggccagtgcttggtgtcgttggtgggttcgtggctgcgacgggtaaacgtccgttccgcgagccgggcaaggcaacccctgcgggtcgcgcccgaaggccggacccctccaagccgcctgggagcttccaaacaggtggacccgaagctcctgtttgatcggagaataacgttcaatttactccgccgctgaactgatggtttaaatattcatctttggatatggtttcacattaggcaaaagttaggagcttggaggcggttccgggaaggggcctgaccctcagtcacccacgttcgtagccgggtgatctgccctcgggcaagagaaggaagatgattgggagggtgccaagaaagcctggagaaagtcccttctgggttcagcggctgtagccgctctcccaggacgtttgttggcaataaatgaaggaaggtcggcccggagacgttttcgcacaacggacagaggggagttggagcgtaaaccagcgagaagctggcatgacataggatccctctattctcagtttgtttccaaactcttagactgccccagccctgccggatttgctaaaagtggtctcttctggacgccggtggggctatggggctgacggctgcctgtgcaaagaagagggaagaattggaagctggggtctgggcagctaccaaagatggggcttgggaacttttcagaacgtcctcagaaccgcaggagccaagaggaaatctcccgtaggggatctcaggtagggcatgccaagaaattccaagagacgggatggagaagagaagccggagaaaaatcggccaattagactcctgtaaaaatgtgtctccatgtttgtcctccctcctgaaataagaaattcatagctgggggtggggagtagatgggggctgggggaaaaactttctcacattcacagagcagcttccctcaaagcggcacggaatcgggaaccccactcgggacaggggaaaacggccaagttcctagaaatttgttttctttgtggggagcaattcatgatgggcgttcttgtctggtttccccccactccgtcccctgacgccgagtaacacttaaacctttctagttgcaaagtcttttcagagttttttttttaggaaataagttttgaaaattctagtgcttaaaaaatgtgtatatatatatatatatatatatatatatatatatatatatatatatatatatatgtatatttatagccttttattttccctgagtacatgttggccactacattccaaattgatctcaaatggttttccagcttgttggggggtgaggaaaaataaatggagaatatatttacatgccctcctattcattcttttagaagtctcataaatagtaaatttcctattttaaaagccaggacattttcaacctcaaatatttggaatttttaaaggccatattaaaatggattacttctgctatctataataaatatgaattgtgaaaataaattgagggaaaataatgtaggttttaaaaagttccatttagaaagggaagaatgagacgtaatagaaaataaacgatgtagtgtagtgacttagcattttatttcgtctatataactaggcttaattttaacaccttaattttaacattaaagatggcacgtcagacacacagataagaaatcaatgttctgaaattaatatcctacttacattaaacatccctatcaggaagacacagagagtagaagcattttgcactagacttaggaataatacttccagttccaaggaagtgaagaagggggaacatgtttggcatcggaggctgtgtttttgtttgcttgcttgtttttcttttaatgccagaacaaaataccccactcacgttcatagtaccccaggacatgtgcaaatcgggaaagccacagaagccacaaccgaaggcaagaaaagatgacttgacgccctgcgaaggttacgttcaggtggtttttagaggaacgtaatccagctgtttctttctaaccattttgcagggaacagaagttcgtgtttgctctccagcgggattcagatgcacacgcccagtatgggccgcgcaaggtggagtgagcagctgcgggtcgctccccactcccacctggctctaggagggccctgcggactcggccagggaactgggcgtgggcgatactaaaaaaactggtgaggtcccctctccgcccaaaggggcggccagcgatgtcagcccagagccctctgccaccgcctgataccgcagcagcgccgacgcggccgacaggtgcccgcccagcaccgcgcccttggtgggagcgcagccgttggcgcagtcctcctcctgatgccgctgctgttgctgcaaaattgtccgacaggcttgacggtcgctggagcagggggcagtagctccacgcggtcggggacaaactctgcgcagcccctgtacccgctcccctgaccccttgcatgatactctcaatgctgaaagagatgcatccgcctcccggtggcgacgccagacccttgccctcctcccaaggctgaggaccaagtgagggctgcagcacgggaagggtgccggggtcgccaggtccgcgccttctgctttcttcggtgccccggcataggcgggggccgagagcagtaggtagcgaggaggatgcgggtgcagcagagcgtaagggcgtctcccggggccggtgttggggtaggcccccgggactggctgcggcggggcaggggccccaagcagagggcctgggcgggggttgtgcagggcggcgtgtgcagcaggtagagggaaggggtggggcaggtgggctcccggggtcggttggtggcgctggaaacgcttcctacgccggagaaagctgccattgtcgaacatgtcctgggaggcggggtccaggctccagtagttgcccttgcctgggcggcccggctcgcgggggatcttgacgaagcagtcgttcagcgagaggttgtggcggatgctgttctgccaggcggggaacttgcggcggtagtaggggaagcggtcactaatgaaggcgcagatgccgctgagcgtgaggcgcttgtgcgggctttgcaggatggccatggtgatgagcgcgatgtacgaggaggggggctttgccggctgccgggcatcttcagaggccgccgcagaccttggcggtgccctgaactcggtgccaaactctgaggggtcgctcgggccgccgccgccctcgatgtgctctcggggaagcgcaaccccgccccaccgggccacctgcagccccggctggagcgactgctctaggaactgctggctcgccgcctcctcctcgtcttcatcttcctcctctcccaggacatcgattttaccgtcttccccatcggagtcccggaggctgcgctgcggtgtggagcgaaggcgctcagctcttggcaagttcatggcggagcaggtgcttcagtcgcaggggatgtggcggccggatcacctggccccggcgggctgagctggaagcccgggatgaatgttgcaagaagcaggaacgctagtggttaccctttgggatgttttcctctgcttgtttctacgcctttgcaacaacgtccggcaaagatgccttcgccttttataaaagcttcttcaagaccatgtgtggtggacgcctccctttataacccttcttcccctacctcggagcggtgccacttcctcctaacgtagtccagggatgatggtcttctgggcaaacaccgtccggagaaaagcccagcgccctcctcctcgcacccacctgccaccaaggaagatgctctactcatccggtgcagccagacagtaggcaagcctttgcacgggttctgttaaggcgcatttaaacccgcgcaaataaaagcgaggtaggaaagtaggatactcaacattctacgaccacctcgacatgcagccttcccgcctggagaaaagaaatggtggggtaggaggctgaaatgtacacggttgtttgtaaaggaatgtgtaaccgtgaaagtatgtttttgtgtttcacagctggtaatcacccattttcattggtagagtctgtccttacccagaatggtgagctgaattatatttaaggttctgacaatattcccaggcttcaggggggtgttgctttgctccttctaccttccttcccacctccccaagatgctctccctgactcaaattttcagaaaaggttcaaatgtcccagcactaaattgtgtaagtttattcagggaaggcaggagagctcacacggagtcctctgtccccttgtagcaatggttctccaatttctttgaatatttaaccacagaaatacattttatatcacaatcttacacatacagacataatacataactaagatggctttcacgaaacaatatacttacactatagtgatcactgatatttccttttaaaaaaaaatggccataaccaactaaattgatttcacacataccagtatgggcccagtttgaaaaatcctgttcttacaaagtggccccacatacaagaaatgcacccactctataagggcttctctctctccctttcctccttcctttcttcatcctttataaccaattcatttttagagacagggtctatgttgcgcaggctggctttgaattcctgggctcaagtgatcctcccgcctcagcctcctgagtaggtgggactacaggcgtgccactatgcctggctctggctcttcattctttttttcctttttttttttttttttttgaggcggagtctcgctctgtcgcccaggctggagtgcagtggcgggatctcggctccctgcaagctccgcctcccgggttcacgccattctcctgcctcagcctcccaagtagctgggaccacaggcgcccgccaccgcacccggctaattttttgtatttttagtagagacggggtttcaccgtgttagccaggatggtctcgatgtcctgacctcatgatccgcccgcctcagcctcccaaagtgctgggattaccggcgtgagccaccacgcccggcctcttcattctttcagaaatgtcaacattaagtgcttttactgtaataaaacttgggacttcaatgaggcaagaaggggctgcagtgttgcctttaaatcagtgggtcctcattcactgtctgcactggggaggggcaatatgacagcacaactgttcatctcactcgctccacatccttagaagtaacacgatttttagattggcttcatgaaaattagctcagagactaaagtagcactacagaggaataaaaaaaatatttgttatataaataaggatcttattaaaatactaagtaagatactatgccacggtatatattcataatttaaaacccacctacttgggaaaactttgaggtgccatctaataaaaatgcagcatgaaagaatattatgcccttgatagtcacatagtgtctataattatgacaatgaatgttcagtgagaaatcaaacgccaactgcaagggcaaaatataataaaaaatagcttaaagtagctagtgccttcaggataaaatctggaaaagggctttcttgctgatctttttttgaaactttgctgctcctgaagtttttaccctttaaggctcctcagtttatatgaagcttggaggacaaataacagacaggtttgagcctaacagatttgtttgaatcccaaatttaccaatgactgcttgtgtgacctactaaactaagctccaggagggccaggccaggtgtcttattcaaccacaaaatcccagcgcccccagcatgtgaggcaaatttcctccatcagcataggaatcggatgacctgggaaagggagtattgttagttttcctagcgccagcttcaatagggattggggttatttaaaaatacaggagaaaagtaaggaggcactcaaaaacaaaacacaaaacccacattgatgggggtatgtcaaaggtgggaacaggagataacggaaagagttcccaatggtcaaagctgggataatttgagcaacaaaataaagcagtattaaattgtaacccaaagtataaaatattcatgtgtccacactgataaacataaatgatcgaactaataaagcgaaagggacaactgtcctttgcagaagaatttcaattaatcatgtagaccactcccaagaaagtacactacaactccccattcctttagtgtgggctgtgcatagtgatttccttccaaagagcacagtatgaaatgggggaaaagagtaactttacaatggagaaacctgacaaacactccttcagccaggtgatcaggtcgtcaacatcaacatcaataacagtcataaccttttatttcatgtcataaaatggtgacacttacttgtgttaaaaaaatttaataacaatgtaatcattatatctctgcaatcagctgaagttctaagaaaaaatgacaatgttgaaagttgtatcatcattattataaactttcatgttcagtatatgtaaactccaaagccaatttcaaaagatatttttgtgaaataccattctttaaaaaaaaggatattatatataactgtatgaatgttaaatgttttacagtactgatttgctacattttatgtatgctgtaaaacaaataccattttaaagtatattggaattcgtaactaaagtaataaataaatgcttgaaatatacccagtagaaacttatttttattatccaatccttttgataagaaatgcctctagtgttatgtacaaacttgatcttcttggaaacgtgttgtccactgcttttctgtttctgtcacagtagctataaacagctgtttaaggatatccttatctaaatttctgcctgcaaacaaaacaaaatatgacgtgattacattatgcttattaaaatgacacagttcacctatcaattccagttcattaaatgctttatggtgtttagaaatttacaaaaagaatagtaattgagtgattccatctttaactttccaggtcagtacatcaaagtcacattggtccttggattaaccacttttctaaaactgaagaagaacaaaagtcctaacaagcttttacgaacgttgtaacgtgataaagatgaaacattgaccacaagcttatttagttttaaaagaggacctgaatggttaatctgtttaagtggcacatgatatccctttcaaatatatttttcactttgttttaaaactgtgaatcctttgagacttaccaaggaggaccaatcgatttgttctctcagtgtcatccttccagctcactgga

SEQ ID NO: 411 - DNA, 8000 bp, Homo sapiens
  Locus number 23 genomic DNA region, cyclin-dependent kinase 4 inhibitor A (CDK4I), p16-INK4, p16-INK4a, multiple tumor suppressor 1 (MTS1)
agagaaagactccgtctcaaaaaaaaaaaaaaaaaaaaaaaagttgttttctgctatttcctgaactttattacgtaaatgagacacgtgagatctggaaggaggtggaggtgaagaccctcccacctggcctgcatccagagtacttggggtgtggcactggcgtgggccccaggaaggatcccagccagttttggtgctggaggcccggccaaaggaagggctgctctcccgtcccgcgggctccgaggtcgccgcacccgggcgcgcctgggcctcgtcacccgcgctcgtgacgcgtgcttacaaaggaaacttttacaggtttcggtgggcagggccttttattgcccttctgctccacagcccccgtgcttaatcggttggttgggaggtttctttcgtccgtggttttggaaagtccccgcctccaaaccgcagtcccgcagtcagttctgcagcctcagggcctcgaacagccatgcttagaatccgtccttctttcctgctccatctacccttcccctctggcttcttttttttcactggagaaagcccacccgagtctctcagcctgcttcggaggttactgcggcctcctccacgggtagttctgggacccgggtctagtccgcggttccggagcaggtccctccctggagtcgtcaggcccagtatgcgtgtgctcagtgtgctcgggaaacacgcgtgggctttaacagcagatctccataaaagggtcccggagatagcctctgcctggcccgaggcccagtgcctcaaagcggacgcctttgcgctcccggaggtgctcacaccacagcggagcctgctggcgagtggagcgtaggactgcgaaccagcaatctcccgagaagcggcgagggggaggggaatgtctgtgaatcggttatccctcccacccccagcagaagtcggggaaatgggggtggaagggggaaaaagggagagaacaggagtggggttgaggaagggtaaggaggaaggtgagcttcctacagctgcgggggaaggtggagaaaattttcagggggacagctgagtggtagagctagcgagcttcagagaaatgttgacagacagatgcccagaaagtgaggatgccgggcatgggcactgcgtaccaggcacaggagatatatggaggcaggaaattggcacatcataagcatttgaccatcctgccctaaaacaaaacaaattgaacaacaacaacaacaaaagataatagcaaaagtggcacagtagtgagctcgcagggcccattcctatatagaaacacagaaaaataagcaaaagctgccagaattgacttcgtgggaactctgggaaacagtaagaaagttttacagcaaccaagtgagtgctgaaccaaggcaaaggtaactgaaacgcaatgatagagaagaggggcagggaagtgttgggtagacaaaggcgggtccctggtaagggccctcccctgggcctgtgcccactggacctaggtgaggacaggcactccttccttcacgcccaaatgttgcatatcccaagaccaccctgtcccgccacgcccccatcctttgcctatgaaaaccctgagaccctagcaggcagacacacaagcggctctatgtccagaggaactcatcggaggaactggacgtggagcggggcaccccagcggaagggagcacgccagtggaagagcacactgacagaccataggagtcagtctgttatattatcatagtataatattataaaattattataatacaataaaaatataaaaatataaataatgtaataaatatggataaaaataataattacatatttatatttatatgagaacactatgaataattttaagccaaaaaacaactcgatgttcatcactggatgagtagacgagcaatttccagtatattcatacaatggaatatgattcagccataaaatgaaatgaggtactgatacatgctgcagcaggaatgaacccccaaaacactacacttggtgaaagaagccagacacggaaggtcacatattgtatgatcccatttataagaaatattcagaataggtaaatccatagagacaaaaggagttttgtagttgccaggagttggaggcaagaagagtttaacaggtatgcttaatggggcctcctatgcagttgacgaaaatgttttgggctagataggagtgatggttgcataacattgtactaaatgccactgaattctactctttaaaatttttagttttatgttatgtggcgtgtaccctaaaaaaaaaaatagaggtgcagtgctccagcacgggatgaggcagcgtggacaggagcatctcccaacctcagtgaagtctgagccgcgtgcctgcaacaatcccactgtggcagagaaccgcagagttccttccggtttggcagcagtcattcgcaacctcacagccctctggaaccccagcctgggggtctcagaacgccgaggcggggactgggagccgagtcggattccgagactatgggccagggttggctggattcagttacctggctgaggcctggtgagcaaaatatcccaaacctcgcgtgatctggaaggggaagccggataaatacggatctccagatgtgccagtctcgagtctatcgatatgaggtccccctagagtttctattcatcattttaaccgcatttcatcgatcttgagacacggcttttgatattttatcacctcaagataaatagtgttagatgtctaatagcagcgtttttctaagagatacatgaaacaacagtgtcagaaacgatgctgtcttccatgcgatgaaattgttgtaataggtgctcaataaatgttgacaataaatgagtgaatgaatgaaaattattttatttttatttgagctttggttctgccatttgctagcagtgtgactcaagagaagccagtaacccccctgagcttccctagttcacaaaatgcttgtcatgaagtcgacagcttccggaggctgcgaggctcgcaagaaatgcccacatgaatgtgcgcttagggcgtgagtgctcactccagaaaactccaacacagtgaaaaggcagaagcggtgtttttcttttttacatttttataagaatatataaaaaatgatataaatggacatttacggtagtgggggaaggcatatatctacgttaaaaggcaggacatttttaaaagctctattttctaaatgaaaactacgaaagcggggtgggttgtggcgggggcagttgtggccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacgcatgcctgcttctacaaacccacaaatggtttccgatcatttctgaaacaaaatggatgctcatttattcatgtgctctggcttctgccttcctctctaatctcgttgcgtatgggctccagctcgccgttcggttctcccgaggcagcatttacacttgagagtctcaagattattttattcctgagggagcatttgcacttgaaagtctctttttacgtttattcctgaggcagcatttgcacttgagtttctttctcccgtagcttgcattagattctccgaccactctttagcttctcctcctattcacacttcatatttacccattgcattggttttataaactcgctctctgaaaatagattgttatcttccttaacgtctgtttcccaggtcgggcaagatagcttgggactgtaatcccagtactttaggaggaggaggggggatgatcgcttgagcccagataacatggtgagaccttcgtctctattaaacaaacaaacaaacccaggcgtcgtggcgtgcacctgtggtcccagctagtcgggaggctcaggtgggagaaccccttgagccagggagtttgaggctgcagtgagctgtgatcgcgccactgcactccaggttgggcaacagatcgactctgtctccaaatgtaaaccccatgagggcaagactcttgtttggtctcattcaccttggcgtgcccaccacctagaacagggctgatcacgcagtagaatctaaccatataattaattgtgcttgaagagggggtgttggggagtaagagaaggaagggaggagggaagaaatgaaagacttgtgtgtttggattaaatatattaggtttggttaagagtcgttcagtttattcatttgcttgtggcccaattcagtagttttactccctctcccacttggctcctcaggctttttgctcagccctggaaccgcgctgtaattggcagctccttctaaatcgggacccggatgctagctgtaactggagccgaagtctccttcttcacctcccgggacctggatgctagctgtaactggagggaattggcgggggggaggggaggaggggccgagtaaagaagaacttcgcgtctttaacttcgaaggtgattttgcgttctgtatttacagcatctccaagcagagggcttagagctaactcttcaccctgtcctccccagctcccctatggcccaaggagcccaatgcccccgttctgggccaaaataagatggatttcataatcttcaaggtcatgttttaccttaaatattcgtgttaattcccgtgtactgtttcatatatctattttgtttcaaaaaaaaatgttcctccccccagaaacaattgagtaatgttggcagtttcagcagacagctgtgggagtagggaactggggccatggaatgggggcggagggaggatgctttgagatcacaaaaaggaaaggcaagggcaaggaggaccataattctaccttcatcgctcagcgatctcttgcacaagtttaagagggaaaggagccaactccggtgcacagactgccagggtcagcgaagtcttggtcctgatgtccccagaaccccctggggcagctctggaaaactctaccgcataaagcggagggtcagattagctgaggagggtcagattagttgagttgtgcagaagagccgagatcgagagatctccagatgatgccacgcacaattgggtttggaaatcctgaggttggtccagccagcttggtatgcaaatgaggaaacagacctggtaagtggatgcaactggccctagtttggaggaagagggggcactagacctctagcctcttgagtcttcattgctccgcagtctaggccttgaactagcagagggtaggtgtttgggtggtggtatgctttgggaagtataatgtacaaaatgggctttcacgtgcgcaagtccatttcgggattatttcccatttgccgccctggcggggcagggcgatagggagactcaggccgtcccaccgattggcgcgtgagctgaggcaagaccggagactggtctcccgggctgaactttctgtgctggaaaatgaatgctctgagctttggaagctctcagggtacaaattctcagatcatcagtcctcacctgagggaccttccgcggcatctatgcgggcatggttactgcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcgtcgtgcacgggtcgggtgagagtggcggggtcggcgcagttgggctccgcgccgtggagcagcagcagctccgccactcgggcgctgcccatcatcatgacctgccagagagaacagaatggtcagagccagggtgggggccggcatgacggaaaggaagcttgtgtagagccccctcaccgccaagcagacccccacacaagccccaggtgtctaattacccctacatttgcttccagtttccaatttccttcttgagttctctatccattcttcagtacacaatgaattccattatatcctccgaacttctgcggagctgtcgtcacaggcagagagcactgtgaggcacgggcaaaatagcaaaggggcagggacagactgacttttactccaggctaacttcctgtatttcccctgagatacaactactgaaatttcttcctgaaattatgttaggcctggagatttttttttttttttttgttcactgctgtatatccaagcgcagaatgtggtaattgttaaaaagagaaaacttgtttgtttgttaaaacaaattctcacaaaacttttaagttacacttagcttctgggaatgttgaacttcaatttctttttcattatattagttttaaaattatatattgggatagtacagttgtatatatttatgtggtacaatatgaagttatgatctttgaacacaatggggaattattaagtcaagctaagtaacctatccatcatctcaaatatttgacatttttgtcaaatgagagcatttgggatttactatttagctatattcatcatgctatgaaacacatctcaaaaaaaacaatcaaacttattcctcccatcttaactgaggctttatatcttgattaccatctccccattcctcccaccccccagctctagtaaccaccattctactctttactgctaagaatgtaattgttttatatttcacagataagtgagaacatgtgatatttgtctttctgtgtttggcttatttcatttagcataatgctctccaattccaaaacttcaatttcttcaagtataaaataagaaggctagtttaattaaccctaaaattccttcctgtggtaggctgaataatgcccccccacccccaatgtctatgtcctaatcctcaaaaacttttaatacattaacttatgtggcaaaagaggctttgcagatgtgatttaattaatggtcttgagggagattatccagaattttcagggtgggcccaacataaccccaagtgtttttattagagggtcacagtcagagagaagatacaagaatggaagcacaggccacagagaaaatacagagaccatgagccaaggaatttgatggtcactagaagctggaaaagacaaggaaacagattgccccttagagtttccaaaaggaatgaaaccttgtggacccatttttgacttctgatctctagaactgtaaaataataattttgtgtttgttttagctaacacatttgtgataatttgtaacagcagcagtaggaaactaaaacacttcccaggtttatgatttgagagttcattaaacaagagatggtcacctctttggttcctaaatcatcttggaaacaaagccatttccagagaggaattttaaaatactgtctgcagtcatagcaaccttaaaatttgagtgctgcatggtggaagtagacaatttattttaggataactgttatttgttatattagtt

SEQ ID NO: 412 - DNA, 8000 bp, Homo sapiens
  Locus number 24 genomic DNA region, hamartin, tuberous sclerosis 1 protein
ttttctattcatgaccacgtgtttcttccaatcccataataacaatttttatagactgtatagcagagccttgtcaacggctttttgaaaatccatcaaagttctatcagatgcagatctgtgtgtttattcacctgcagggactccggagctcatttgctctgcgtcttcctatccccctccccgctaaaactgtagtgcacctttttaaaggaattccatgctgcacagcagcagacttcgggctcctcggggcctgtgctgactctggttagtgtcaggtggggatccgagtaggttatgcacattggccaaacagctgagacaggtatgctcacccatagtgatttctggatggaggccatccaatcccaatatttatgaataccaagctgcttaattggtttcaaggtagactctgcccttaacgcttattgtactaatacctttgcccaggactgaattgcctctcgagagtaatactgtcacctttccatccttagaactacccactgcagcatgatcaagtgacctgttgactcttggcaggtttatcatgtccaaaaccaaaccaaacctaactactgactctggagttctttgcaacatgaaagcctacatttttaggttgggcaccttcaacatgactccaggtctcattctcccaaccgtagttgaataaaacccacagcctcctagaactcaaaggcacctgagcttggagccacatttgttataaagctgagtaaaaggacacccaggccgcatggatgagctgaggaccctgtgcagacacgtccatggagcttctagcacaggcctctctccatgctgcctcctttcttccctttatttttataagctgtccgtttctaaaatgttttttcttttgcacttgggcctcttttcctttccaattcaggaaaaggctttaagtgcctggtatcttgttctatggcacagatctcttgggcatgaggagaaggaaagcacttaaaaccagtttcaggattcactgatgggatttccttccctttctaagtttgttcacgttttccttttctaaaacggaaccaggaaactagactgtattgggttttaagctttcctttggacaaagctgaattaaatgtgtggtgtcactaatactccacatctgacaattcagtaccaactgccagcctgtgctaggctgagtagttgggaccacgccctgccacaggctgggaatcagtcacacccagaaagcctgcctgaacaggttttctgctggtatagctagggtgacagagtctctaactgtctagtcccctttagttagggatgctagaatatttattgccatgctaaaaaaaaaaaaaaaaaaaaaagactttcattctctctgctcgaggcctccgtgggcactaagatttcgtaccgtgacagttttttacctctttatgactgaatccttctattctttttaatgaaagatagaaacaggaaagccaagttcactggctccttcctaccaaatccccctgcctcagctggaacaccagaccacagttcttaggcttctagcgtttctttcaggagcacttgttgagtttggattctctgccactgccaattttctgactagtgtcatctctcgggagcacgtggggcagcctagtgggtatacacagccagcctttgccagcattctcccggactctgtttagactgctctgccattactaacatggagagtgtgatgacatcagctccctggagagtcagcccctgaaagttggaattggtatgaaaaagctgcccctcttctggtagcctagaacctgctacagtgaggcaaccctaatggcctgggaaatgatggtcacatacactttgcagaaactctttggaccttcagagcctttctgctgcagtgtcacatataagctgacatgaacaagaggcgtatgcacacaaagggaggccagtagacagaagggtttaacaaaaggcccagcaagctgagatggcctaaaggtgcagttcctcatgctcaagtgcttctcgggtaacctctcccagtgactgctccttccctcctatggagaacaggttttaccacctacacaccagcctgtggtcacaatagtaccagcattcaagcaaacaccaaataaataagaggtagtgggggaagaagagacaagagctttcccaaagggtgtgtggtctccacagtgccagctccagatttctgaaacaggcttctgtttacacagaactttctaggaagcttatcagaactgccaaaagaatgcaagtatgaataaaccgttgttcttctagacctgctgctttagatgctgaacttcagaatcaaaaaagcagtcggaaagtctcatgtaaacgctttcatgtaaagacaaccagctttgcaggctatgtcctcctggaagggacaaaaccagacttacctgcaatgcaacaaactacctggtctaattgagagccaacccagttatctgaacttcgggaaagcagaaagtggtgtgttagactcaaagattaaatttggcctcatattgcacaggttcaaaggacgcaaccatttgggggggaaaggaagaaagtaaagctactgaggaacaccaactggcccttggattagaacacactgcgaggtaaatgagagggggttagggcgggtggaggggaaggtcaagaggcatttcaatgccagatccaaaaaccgttctgcattcagtcagctgtccaaaggacctccgtcccatttccacacatgaacttgcactcagaccctggaaacaggaaagctttgaaacgtgcattcacacctcctgttctgtgccaacaatatgcaagttaacactgattgaccatcattccttagctgtgttcatgatgagtctcattgtagtccatgatatgtagctgtccaacactgtccggggtcgggggagacgggtgagggccatctaggttcaggggaatcttggcttccacacccaagtctttgcccagttctgtctttaggctctcagaaaggctactggtcatgccgtcctcatcacactggctctcgctcttattacgaaataactctcgagccttcatacccaggaagctttttgaactgggaagtgagcccacagtggtggggatgctggcagacgcttctcccatagtcgtctcccaccgactgctgaatgggcctgccctctggtgtgggggtttctctggggtagaaagctcgctgctgctgctgctgctgcctccaccacctctgcttccactactgccccgggcgctgctgggcctgggggtcttggtctcaccgttgtggccagatgcctcttcattgtgccctaccatggaatctgagcacccgtcattacaacagtcaagcctgtaagaaagccggggaggaaaaaaggagctggtgattggactgtccacattcggaggatgtggaattacactgacactcactcacactgacactgaactccgctagcccactctctgttttataatactggactcaagagatctcatcaagagaaacctaaatcacaactagggatagtaggtggcaatcttaagtgtgaacacttcctgtggccatatggagggactcaaggccaggaacacgaacacgaagagatcactgggcgttttgaggaaaggaacgtcagagtgggtctctgacacggagtgagctgagtgttgcagcctgtctagtcagcagtaactgcttcccacaccacgtgacacagtccttatgctggaattggcagcttagtcccaaggtcatgaatcagttctttgttcctacctttcttctgctgcttcagctgcttctgctttttcttcttcaagttttttcaggaggccatctttctccaacctgccatataaatctaagatctccaattcaaacacctgggttatccttttctgagcctcatacctgctctctgcggcctgcagctgtcctctgaaagatacagaccagccagaatataggaagttccacttaataaaaacacaaaagcctttcctgatgaaagttaccttgcctggagtttgacatcctctagatatttcttctgttccaaaagaaggtggtctttcttggccaggtgagattccagttccaaaatccgtttttgggaggtatcaagcctctgagtctgctggagaacatggcttctgtttttttctagctctttccgataggcggctttcatcatttctacttcctgaaaaaaaaaaaaaaaaaagactggaattagtacttataaaaaataaacatgctgtatccattttgaaaagacaatgtaagaaggactgagaaggcattttagtatactgataacagaaatataaactagtacaactttatggaaagtaagctggtagtattatcctagtaacccttccttgaaatctatccccaagcaaatcatgtgaaacataaatagagattttgcacaaaaataatcatcacagcatatttataagagcaaaaacctggaaacatcgtttaagtctaatgtcaggggaacagttaagtaaattaaaatacatcctatatttctaagtctttttaaaaaatgatatggtgtcagtaaaaagattaaaaagcagactacaagactgtgtgaatagtacaatcaactatgcgaacatatacatatacaaaacaccaagtgaaaatacgccactatccagttatcatttcagtccagtggtaccgcaggtcacttgctttcctttctccttttctccccctcctgacaatagcgcaggtgaggctacagaatggaatgccaatggagcaggtctgctcaagcaaagcagcctttgcagactggatgccctgacaaggtttgttgatcgtgctaaggcagatggcctgctgccgacagattggaacagcttgaaacccagagcaagtacacactaatgctcagaaagaaggcggaaagggtatttttttaagcctgtgttacatttgtgtgtgtatgtttaccgtggtaaaatatacaaaacacaaaacttgccatatatttgttttttaaaaaagataataaaccataaacagcaaggagatgagctttcacgaaggcgccctgccttgatgctgtctggtaagcccaatgcttccttgttatagaacgcaactgattgaaactcagaactggctctcggataatgcggctgttccagctgtgctaaatggctcgacttcagcacagggtggatgaacgcatctatctggccttcgtcataaacaacaggacttattcatggataatcatgcaaagcattgaaccaggaacatccgtgcactctcactaatccttacagctacccctaccaactgttcccacctgattccccaccactcactcttcctcctcctttggatggaacaagagcaaccctagctccaggttcaggagcaaatcctgactgggttgaggcaatgactaggctagggatgggcacaggacaggcctggccaacaggggtgatgagaagtatggtgggatcatctgggaaaggttttcttttccttttcttttttttggagacagagtcttgctctgttgaccgggctggagtgcagtggcgtgatctcggcccactgaaacctccgcctccggggttcaagcgattcccctgcctcagctccccaagtagctgggactacaagtgtgcgccaccacacctggctaattttttgtatttttagtagagacggggtttcaccatgttcgccaggatggtctcgttctcctaacctcgtgatccacccgcctcggcctaccaaagtgctgggattacaagcatgagccaccacgtccagcctgggaaagattttcttgctgaggaataggaagagatgctctcctcttctgtggggacatcattgtgtctgcctgtcatatctgtgcctgtggcacacacctggcaaccatgagtgcagctagctggaagacaaggtctgcaggataagcaaggcagtgcagaagagtggaaagagcctggctcctcgatgctgtccctgaatggccaacttgaccaacctggaactcacctgcctcacaacctcttgtcaagtgaaacaatacagttcttcactgttaagccagttgagtgctttttgtttttgttgtttttttggatattgttaggcttggtctagaacttctgagctcaagcaatcctcctatttcagccttccaaatagttggcactgtaggcatgtgtcaccgtgcccagccctagtttggtttttgttgtctacaattgaaggcatcctgactatcacaactcagctgcatcacccgttttatgaactgggaaacagggccccatggagaggcagctactcaaggtcccaaacagcacaaggactccttggaggccgcccatctaggcttctctcaggagatggcccaggcacgtttcagcagctttttcaggagctctcttgtgcctcggatctgtttctccccctttctgttcccagtcattacacctccaaaataagtgatagctgctttctagagaaagtcccacacctaacatccttctaaaaaagggagtctgaatctgagagctgagaggagccaagaaataaagagtaactctattaggaaaattactctctccagttctaagactcctctctacatccggccgaaaaagactctttacaaagcacatgcccaagaaacccaaaaagaaggcccatgtgtgatggagaagttagtgacaggaagtatctgaacagctactattaaaattcaattcccacctcattcactaacattacctgaggctatttataaagtgacttaaaacttctgcctcgacaccactggtgaggcactaattaatgtaagatcatcccaatgctggccttgttgccaggactgaactaccatctgcagaaatccaacattaaaaggaaaaaaaaaaatggtatgtacagcactctatatccatggtcctgagaggtatgttaaacagaattggtcccccatccttctttttctctctccctctttgaaaggcagcctagggaagagaaaggaaacactttacacctactctctaccaactaccattaggtgctttcagtgtgagttaacttcaaagcaacccaataggagaaacaagctcacatggtggctggaaagtgcttgtatagctggaccacggagtagtgggactgccgctccgtcttttaggaaataagtcatcaagccattctctatgccatgcgggagacatactgtctgggtctgaaacgctttccccactaaggtctggctcccgagccctggcatacctttgtggtatctgagtgcttgttctgcagttgttccaaatagagctcgttgacctccccaagaaccaacagctgcctgttcaagaactccatctgctgctggaccgactcactgtttgagagctaaccaaaaaacatgagcaaagtgaaaaatccgacgacataaaactagcacatagacgtcattaaacagggaatcagctaggagcacactatttcaatgttaaggcaaaataaaccagtcccatgggttcacagtccctgacataatggcaggtggggaggatggtacccaaggacaacaaaaatagacagaaacacacttcagaactgtgctttgcaaaggggacagcacaaatgcagtccatcaaactgaccacccacagaacacctggagaaggtggacaggtataccaccaaggcccagtggcataaagccctagggaaaactcaccgttcttgacaaaatgatgtatgaagtgcagtgattcccaaagaaggaggaatcacgctcaaaaacctgaacaaacttttgacatttatgtaaacaaggtatgaagaaagagttccatgggatacacatagagcagggtttaggatggatacttctttgttgcagggggctgcctgt

SEQ ID NO: 413 - DNA, 8000 bp, Homo sapiens
  Locus number 25 genomic DNA region, Feature name CHR10P118975684
ggccctgaggggagctgcagcagcggcggactgaggtctctcttgcactcgcttgctggagggagttagggacatgtctctttttcttttaatcacttattatttttgtaggggcttcccatgctttgcaaggctttgctctcagcgggatatagatgccctctgcagggccaggagagatggggctcagtgcactccgggccacagggccctggggaaaggctcttcaggaagcctcagaagggcagggagctgggcttctgttccaccacgcactagcggccctgctccctgagggcaggccttggggaggctggaccttaggacttgcatctcgggggctgggtctttgctgagtctggaactggagtctgggctgggtgaaaggatcaggcacttgatagaagggtgctctgaaagaactaacgcaccccatctgcctctcacccgcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgccctcagagtagtcgtcttgggaaattgaagtggatctttaaaaatgtatctcagtaatttgagtgtggtccttccccaactaggctcaagaaacccaggctcctcacccacaaaagggccagattgatggattctcaggcattttaaagaaagatgagggtggagaagggagaagattaggaaaacttaagtccttcagaaaagagatgggagaaaagtttttcaaccagactttgcccattgtatgccctcctgagggagtttagtttgaacttcaggttaaaatgcttacttctcttaacctctggttattaaaaaaaaactggacatatagttacacattgaggactactctcccaaaatattggggaaaacatgtagcagaatcttgcaacttctaaactttctgacttcaaaccccaaagtacaagtcttacttttccttcctttctttcctcctctccctggccccaatctgctgaaggtgatgggccaagcccaagggcctcagcagccttataaggcaagtgttctgaaaaaccttcaactcttaattttaacattaaagaaaaagttgtaatcagacttggaggaaacttagcttttttccctccctccttcccccttctgggggtacgaggttgtttttgcatgcttcatttgcttcttatcctgataggctgcattaatcagttttatttccattgatagagaaacctcgtctgttctgttcgagctacaaagcgtcctgcgagcttttgtgaaagtgcaaatcagtttaagcaattatcataccaggaatatgaaggggaaagaggaggccttgcccagtggtctcctttaatctcttaatccacggatccaggggggctgcctggacataatttaggacaatctccccaccctttacactgtgataaggccaagttacaatgcagggcaaaaatacaagctttgttaacatcttgccttgaaaagttaagattagacattccgtgcacgtgtggggactatagggcactatggaaattttttcttttttttctcctcttctctaaagcagaattcattctccgtctctttctcctttcccccatctctgcctgtcttccacctcccctctttccccccatttctgtccctctgtagaaacctggctgctcatagtgcattttcacagactcttcttggaaggtgtgtgtgccgtgaggggatacaccgccgccgggagttgccgggggaggagggagacggggtggcctcaggagacccgggcttgcgtctcacagggacaggtgcgcctcggggtatcctggaaaccctcgtggggcttccaggcgctttgacagcacgaccctcagtgaccaccagctgtctcaagcgctttgcagtcagtgctcccggaaagcatccctttctcttcaacaagtacaaattaccttttccttccactcaccttccaaaacccggaatacctcaaacaccgagctcattcttaaacattcttaaaattcagatggtctgtccagaaaaaaaaaaaaattccgtcttaacagaaggtttacttctgccgaaattatatactttatactttttaagtacaagaaaacggggctggtggtgaagatttttctttttttgggtaaatgtcctatgtagtgtaacagcaataaaatcatcacagaatactattagctttgaaaaaaaaactaaaagctttattacaaaccaagctttgaaaataggggggattaggcggctgaaagggtcccacaatggtaagaagaaaaggtttcatgctaatgaggttaatgccctttgtatctcaggcctccacatcttcattacgcgctatctccggctgcacggagcggctcagagagccgcaatccactccaacgccccccttcccggcccaaagaaggatttgatagcagctctgttcaaactagataattatatcttttcaagtcggaattaagataaagaaagtgaagcagaggcggctcgccttgatccactgcaaacaaatttggcgcactttcgagtccttcctccgcctcaaaaaggcaggacagtcagcttattagccgctcgtttgctttattaattcatctatttaaagtggcaggattagagtgtctaatgtggacgcgggctgccgtggcgctgaggaatataaatatttgcgagatgccatcccacgatgactatctgggagtggggcgcggggcagggtgcgcgtgtgccctgcctctgcgttcccttcgcagtgcgcgcgtgctgagctgagcagggggttgtaggagccatgagccgcaggtctatgtgccccttcgtgctatatgggtgccagccctggatgctcccgggcagggctcaatgggcatcgtgggtcagattctgcgctccttctgggacacggagaactgtatgcacgttgccattgggtcctgcctgggacccctaatggggatgtaggatacaagtttgatccatgttccgtttccttgttaattacttgtggaccttccctgtgggaccccttggccaagcgcatgttcgggagaggcacgggttctccgtttgcgctgccctgagagggtcaaacggaatctaccaagcgcgtgtgccgcggctacgttctcctgcgaagtacacatgggttccgtgtgcgtttctcgcggaggcgccagaaagtcctagggtgagagaagccttcgacctccgaacttcctggctctcgttctgggtgttcagtgctccaagctccctctggctctgctcctggcaggcaagccgagcaggagctggcgcattggctgcggcccggaacctgccgggccacttttgtgcgaggggcggattgtggcagcctgagagccgcgccaggcgggccaggcagaaagggggctccggcctgcgctcggctttggaaacctcggctcctccccgtccccgcctcgagtcgcaggaaacaaagtctgggacgcgcaggccggctggggagggactctggctgctcggaggcctggcccggggccccactccgtggtgggggttttagggctggtccaagtcggtgtaaggctggcagggtgagggtctgttcttgtgtgtttgtatagggtgagagcactagtttgtggtataatggcatttgtgtggattgtggaatagaattgtgtgtctcagctaggactttagtcaatttgtgtcagttctaattgtttgaataagttaaaggctggagaggctggggctacttatgtagatttggtcaagatgtctagctgtccttgtgcgtctagattgttttgagttagggccagcacgtgcagttgtgaggctgcagagtgcctatgacggtgtggaaatgcagtttattgaatgtgtgtgccgcggtctggttgcactgtgtatctgcgaattcgtctggagttgcacatctcagaagatgggggtggcctcggtgtgtgtggcttgcggggacgtttctcggtgtttggatgggggtccctgtgatggatgtccatgcccagccctagggcaacatctgtgtgtcttgggatcgaggcgtgtgtgtctagtgaggaggcttgggctggggtgtcgttccagcagcgccccactaactccggagtttggcaaacaacagccgttttgtgtaactgcgcatttttctagaccagtctttattattccagcaatcagcgctggaattactggggcgccgcctagaagcaaccgccggcggggcggcagaggatgccggcctccagcgtcgggggaccgcgcccgaaagccgggctgctttgtggggcctctcgcgcctcgcccgcagcttccggcccgcgccctccgctcgaccgccgattttctcgccccagccagccccgtagccagaggaaagtgggagttttgagaaccctctgaccccagccgtgacccctctccgggaggtggcttctcccgcaggacccggtgcgccagaaaactctaggcggcgccacgcttggaagcgcaaggtccattcatcagccgcgccccagcgtctaattggccttttgtttattagtgtctgttgcccggctgggagtctccggagggccccggagctgcgagtcggggtgccagaagcggacggcgggccagcgcccagagctggggtccgggtagggcagaggcgcgtcgcactcctctgagggggcgccagagcgcgccaaagatcacgcccacgtgcggagatgcgcgcatggaggctggactccaagtgctggagcctggtcctcccggctgctaacgccccaggcttcgcccctgcccccacctccacctgcagaccgagccctccccatctctccacaccctcaggatttcagacccgccttcctgcctctcctaagtacccatcccaggcgctggccttgtggctcggttccgctcacgtcccgcccttcctcgttcttcgtgcttcgagttcattagtcgtggctccgccgctaaccccggggagaaagctccccttttactctgggtttccctccctaaacaccaacccggcagtatggagccagcctcctgcttcgctgggtggtgtgattgagagaatgtttttggcaaggcagggagagagggacgagacagagcactcaaaattccaccttcctcaccaagtcaaacctcaccttccgatccctatctcccacccagtgttcaatctccacatcgagcctcgccatcctcctccctaccccacacttactgcccctcctcccattcccgagagacagtacagaagtaaggtctccattcccagcacaggcacaaaggccaagatgcacctgggggtcctgaaggtgcttgggatgggcatgcggtctcatttggaaaatgacttgaggatgattggcctcgcctggcggtggcctggctgccagcaacgtctggatggctgggcctcagcctggccccagacgtcccctgctcccagccagctccaggccctatatatagcacgggtctccatagccctggctggaccctgacgtcagaaagaacttgatcttgcctgcttcgctcctgcttctgaaactgatccttgaaatgagagaacagactctacacaattcccatggccttgacataaggtacagcgataaatatacaccactaatgagcaattaccatataatcaccttccaattagctcgcataatgatgaattaaacattctagcaggcgggattaggtttcttactttgtatattatttacgaaggctatagcttctgcaaagaaccaaatatcaaattagatgggggaattttcacttgggggtaattatgcattcaggccagcggctgtgttctggtcacttgtcaactgaggcctcctgcaaggtactgaccagtgcttttgggcatttattttcctttttttccctctctctctttaagttgcaattgccttttccttttccttttactactctggcccgtgaggtgagaggctggggacactgaggcggggcactaggtggggtttggggagggacctcagagaggatgtggtgcaggcatcaggccctgtccttctggccccattcgcttggctcttgttcccgtttctctccagcccaagaaggatgcctgagcaatcggctctgcacagctactgagcacagggccagcgcggctgcccactcacctaatgccaggggcttcctcccgctgcacctggtgccaccgcctgacattccttaggcccccccggggcctcagtgcagtctatgccaacttttacccccactcccaccccagtaacagggagagaaaggatacggggagttgagaaaccaacgacaaacctccacatcgcccgcagccacctctcttgttcggaaatgaattttggcaagagattagttcctaatctgatctaacgctgctgacatttgggaagaagatgaaaatggcagctcaatttcattctgaaacagggtcacttcgcagggctctgctcttcagagaatgtggacgcccctcccctcccctaaaacagaagagcta

SEQ ID NO: 414 - DNA, 8000 bp, Homo sapiens
  Locus number 26 genomic DNA region, Feature name CHR11P021861414
ctgccattaattccatctagtatattgtatctccaacattgtaatttctattcctggaagtttgatttgtttcttcaatgtattttctatgtctcttttgttttttattttttgagacctagtctcgctctgttgcccaggctggagtgcagtggcactatctcggctcactgcaagctctgcctcctgggttcaagcgattctcctgtcttagccttcccagtagatggggctacaggcacacaccaccacgtctggctaatttttgtattttttagtagagatggggtttcatcatattggtcaggctggtctcaaacgcctgacctcaaatgatccacctgcctcggcctcccaaagtgctgggattacaggcatgagccaccgtgcccagcctattttctgtgtctctacttatatcatgttcagtcttttctctagcttaagaacatgtgggatacagttgtttaactgttttaatttcattgtctactaattctataatctgtgtcatttttggttacctttccactgacatttcttcttattgtgagccataatttactgcttttttgcacttctagtatttttttttttttttttttttttttttttgacgtagtctgtcactgtcgtccaggctagagtgcagtggtgcgatctcggctcactgcaagctccgcctcccaggttcacgccgttctcctgcctcagcctcccaagtaactgggactacaggcacccaccaccatgcccagctaatttcttttttctttttttgtatttttagtagagacggggtttcaccgtgttagccaggatggtctcgatctcctgacctcttgatctgtccgcctctgcctcccaaagtgctgggattacaggccatttctggtaattttttattggaggcaagtccttgtgagttttgcctgtttggaatgctgaatattttttgtattccagaaaatattatttaacacatttctgggttttgcttttaagatttgtgtggagggggagagtagcttttattcaaggtttaaatttttctactactaaggcaagatatttttagtagtctaactgatttcttgtgaattatgaggcctctactctgattgttgaaaacaggttctattcctgcattttgttaagagctggtcgttctttctaatttttcagagggttctttctctgaccttgggtagttttacgtgctgattggtacttaactaaatacttgaagaggaccctgtagggatctctggcattatgcctgtgtagttttcttctctctggcactttatcctgttaactctcaccacccttgcttccacagaatgctggctccatcttcttgcctcactgagtataatgaacttgcctaagttctccaccctttaatgcaaattatatgcatcagagccattaagcgatggaaattataaagtttctctcattttttccatatcttataaactactgtcctttgttgcttaatgtccaataatttgaaagccattttttatacattttgtgtactttataaattgtttttgtttggagataaatctagttcctgataatctatcttgaccagaaatataagtttcacattattgattattgctgttttaactgaccaccttaacataaaggcttttattaagaggaaatagagacatgaataaatctaaggaagaggagaaccttatagaggaagtaaaacatggcaaagacctaggctaagaataagcttctacatttaaagaatagcaagaaggctgatgttgaagagggctgaaccacagtgaatgaggggagagaataacgagacagattttcatagagttaagaaggtaggtgatatacaactgtctcagaacttagagtacttttcttcttattagtccatattatggttctgatcaggagagtgaactgtttgtatgtacatttttaaaagatgaccttaaattttatttggaaaattgactttaggaagaaataatagaaatagagaagttaattcaggaattgtaataatctggatgagggaagttggtagattaatgtgttaacaagtagaaagggtgagtagtggtcaaattcacaacgtattttaaagatagagatcacaagaggtttccatgaattggaagtcagccatgagaaaaatagataaagtaaagcaactgctgggttttgggctgatgctatgctgtttcatttgttcaaatgcagattagaagagaagtcattctgaaagcaaagtaaggcaagaatttaattttggccatgttcagttttgaattacaattacacatcgaagcagaaatttaagtagccacttggaaaagctagtcttctacaaattaatcttatgttgtagcagtgaaaactcacctcatccagcaagctgtttatgacttcttcctccctctactatttgccatgtctcctcagaagttttcactgggatttagtctctggaagcaaggcacactataattctccaccacactcctctctgcaattcattatgtagttctcagttcttttaacctctaaggaaaattcctcatattaactctttaaaaaagaaattcttttaagggattatatagtcagcaccattattttttagataatacaattatacaaccacttccgccaaaaccccaagttctgaaatgaggcttaatggtaaaaaggaaaatttgatttccttagggaaatccttagaatcccagaaacaaagagggaaacaagcattgtctcctcagtgtcatgtttacagttttcttcatattatttgcctcttatttcttcataaccttgaagttaagtaaaactttatttgacaaactgaataattcaagtgtggggttctactctaccccctttatatcactgtactagatattttataagttaaaaacaaagatcttaatacttaagaaatataaggaaatattctggaaaacaatgagagtgaagaatttgttgctgcccagtcctgatgacagacttgaatattaatcaaatattaataatagcaataatgattatattccacatggtgatgttttatgtctttctatcgtattcacaccagtgagcacattctatcattctaaaacaactggtctaattttttggatattctccattaaaatgcactaaaataatattgcctatcacttgctagtcttaaactgagaaaaaaggaaatctttaccgcaaagtagtaaaactctgagaacctgcagctgaattcagactaaaaatcataattccaggttaagtctaaataagtttttaaagagttaaaatatacacgtcctaagatgaattagtttgacatgatttggtaacatgatgtgggcatccagatggctcataaaaatgtttctttatttatgtggccagtgttactcagcagaaagttagtttgctatctgaaatgtcagttcccccaattcaggcaatattttccctgattatatttttgtgcacatctgcacccactaaccttctcaccttcattcccagtcccaattcaatccatgcttcagtagagaatttgagcagcttcagttctttttttgcttcattgtgtatttgaaatgggttgagttgggagactaattattaaactgctctgcctgttggcatcaaaaggagcttatgtttgtattggtctgattagagacctgttttcttattctcaggtgaactaaggacatttatttcctctaaattagtgggacttaatacaaaaaacacagagctgataagaattaaagaaaataaacttttaacgctgcttctcatcccctataaatccagtggtttgaaagaggtagattcttcacccaaaggaaagtaaaggattttagtttttcgtgctctagaatatcaaaatggccttatatgctgctgctaacaaaggggcatgcttcaggaagcccatgcccatgaggagctagacttccaaatttcttccacacctttagaaaacaccataacatcattgtgggtctaaccacgacttttaatggccatatgcttcgatactctacattaaacctgcactaccttcaacttggccagcctctcctttaatctgctcatcttgcagtgagtatagagctgtgttactctgattcaaagaaacactctaaaatatagcatgtgatggacattgtgattagttcccagcacccatttcacccttgccaatgattcacctatccagaaaaatgttcatgtgacacaattctgatcatggaggaaagtcacttgggtggggattagtctgatgaaagtctccccactcccaagaaagatgaagaaagaccactctaccccttcctatggacgttgacctctctgaacgtaattccataagagctgtagccatcttgccacacaagttgaagaagcaacctctcagagatggtgactaaaaatatagaaaaaatcaacgtctttaatgaccctccctgttgggccccagattacgctgttttggagctcagtatctgtggtattccagttatgttacatgaaacttttttatttcttttctttttttttttttttttaagatggagtctcgccctgtcacacaggctggagtgcaatggcgtggtcttggctcactgcagcctccacctcctaggttcaaatgattctcccacctcagcctcccaagtagctgggattacaggcatctgccaccagattttgtatttttagtagaggcaggatttcaccatgatggccaggctggtttcgaactcatgaccttgtgatccacccgcctcggcctcctaaaatgctggggttgcaggcgtgagccacagggcccagcctagatgctacttttaaaattattttcttggttttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgacctcctgacctcgtgatccacccgcctcggcctcccaaagtgctgggattacaggcgtgagccaccgcgcccggccatacttttaaaattattttctatcattttaaagtaagattttaatggatatggacaaaagaatcctgaggcatgatatgaagagttttaattaatgccacttgtccgtgacaaatcctctcataataaagtcaagggtttttaatagatgacttaatagaaaacatcagtatgaagagaagctgttcttcctcttaatatgtgaagggttatcaatttctaaaattaattctttatttgcctggtccccatgtagcttttccctgtagtaccaatagctatattcttctgaaagtgaaagtctatatctttagatttgaatgaatgaagagttatcaaactgaatattcatcatgcactctaaagaattatacctaatctgactttttttctgattttgaaagtaacagtcagaataaataaaatgatatcatgacattttattaatggattcagtctccaaaagttgttgaataaactgaagaatggctgtaaaaaaggaatttagatgaattccttggtgtctaacacttttctggatgcagctgctcttgtatctgcctgagcttgctgggcctctggggaaccctgctgaaaacctacttaccaaaatagaaattaggacattgtaatcatcaaatgtggaaaaggaaatagttggagatgggaaagcttataagcctttcttattttactttctaacagataattttggcatttttattttaatggatataattattaatagaaatgtaagtgtgccttcttatgaaatagtgcattacatttcttaacaaagatttaatgtcctatgtaaaacatttgctttatgccctctctattaatctgagacattatatcatgcactatgaaatttatatcttgagatggcatatgttatatcacatgatgttatatggtatatcatttgtggcacctcattagggtgagaaaactgagttcacattatttgtctctgttatatgaggaaagcccttttgtgaatctcatttctctatctctaaaggaagggtaatatttgacttaccttgtagagctgttgaaagaatcacataaggtactataagaataaaaccactttgtaagttttataagtaaaatgcagttgtatttctaccacaatgccaagtttgactgaaacataaacattctatttaatgcataaaataaatatgttgtcttttttataaatggagtattgcatgtgaaataaaaatcatatagtaatcagaagtgatacagaagggtgagcagctacagtggccaagggagcacttaagttacccctccccccaacaccaggtagtgcagctcaaagctctgggagagacttcttccttgggcttgaagagagggaggagagagtaaagaaaactcttgctactttgagaccagctcagacacagtaggataggacaacaggcagagtcccaagcctcccattccaggctctagttcccaaatggataacatttctagacacaccctgggccagaagagaacccacttccttgaagggaaggacacagttttggcaggatgcatcatttgctgattaaagaacccttggatcttgaataagcatcaacagtagcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttcaattaatttttgtataagatgtaaggaaaggatcaagtttcagctttctacatatggctagccagttttcccagcaccatttattaaatagggaatcctttccccattgcttgtttttgtcaggtttgtcaaagatcagatagttgtagatatgcagcattatttttgagggctctgttctgttccactggtctatatctctgttttggtaccagtaccatgctgctttgattactgtagccttgtagtatagtttgaagtcaggtagcatgatgcctccagctttgttcttttggcttaggattgacttggcaatgcgggctctttttggttccatatgaactttaaagtagttttttccagttctgtgaagaaagtcattggtagcttgatggggatggcattgaatctataaattaccttgggtagtgtggccattttcatgatattgattcttcctatccatgagcatggaatgttctttcatttgttggtgtcctctcttatttctttgagcagtggtttgtagttctccttgaagaggtccttcacatcccttgtaagttggattcctaggtattttattctctttgaagcaattgtgaatgggagttaattaaactaaagagcttctgcatagcaaaaaaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagtgggcaaaagatatgaacagacacttctcaaaagaagacatttatgcagcccaaaaacacatgaaaaaatgctcaccatcactggccatcagagaaatgcatatcaaaaccacaatgagataccatcccacaccagttagaatggcagtccttaaaaagtcaggaaacaacaggtgctggagagcatgtggacaaataggaacacttttac

SEQ ID NO: 415 - DNA, 8000 bp, Homo sapiens
  Locus number 27 genomic DNA region, fibroblast growth factor 23 precursor (FGF-23), tumor-derived hypophosphatemia-inducing factor
gctttgagcacctcaaaagaaaaacgtatgaaaaaggctgaaggagctcagcggtaattcagcttcaataaagatagttcctatggggaagatggaggaagtgaaaatagcaggatctaggaaatgatattaccagggacaataagcatctctctcttgctgtttccatataataaggataaaggggagtcagaggatggccttgttcatggaacgggtgataaggacaccagaggggtacctggcagcagcgcttgtgagtcctaagggagcttgaagaatctggtaggcaggagataacttcattttgtcaagtccagtgacccaaagatgggttgtgcactcaactcttaagaatttcttacagcaaagtaataagataaaccagaattcaatagaaatggataattaggaggggaaaaaatacccctcacattttaggtttccatcagtgtaaaaacattgcttaacagtcactgatgaggtcattacaaatccttcaccagacatttaattagttgtgcttcttatctacatgcattaatctttcctctttcttttgggtaacgttttttttttgagacggagtctcactctgtcacccaggctggagcacagtggtgcgatctcagctcactgcaagctccacctctggggtacaagcgattcttctgcctcagcctcccaagtagctgtgactacaggcaggcaccacaccccactaatttttgtatttttagtagagacagggtttccccatgttggccagactggtctcgaacccctgacttcaagtgatcctcccacctcggcctcccaaagtgctgagattatacgcgtgagccaccgcatctggcctcttttgggtaacttttaattgtagtgtgtaattttttcctgcactttttttttcccataatacacatgacaactcattgaacagtacaaaaagttatctacatagactaggaaaagtagatctccctcccactaccctgacccgaagttcccctccccgcattcatgtttaactctttaaagatgcaatgtttagctagtgcctatgtctaaggaaacaaaatcacatttctatttttaaaaatctgaagtcagttcaatttattttgctgcttctcagtcattttaattcactctaactagcactcagtgatcccttggggcctgatacgaggtgggctttcaaggaaaaggtctaagttcagactgccagcccaggaggttgactcttcacactcactccccaccgtagccggcctgttctgttctaccctaattcttgttcaggaagaaacgtctttaaggagttcctttcagcaacgggattccaggattcgagacaagttgtataaacattctctagttggatgcagccctttccatctaagagaatcaaaataatttaccataatctactattctgcattttaaatcacatatagtcttttttttttttttttttttttttttgagatggagtctcgctctgtcacccaggctggagtgcagtggcgcaatctcggctcactgcaagctctgcctcccgggttcacgccattctcctgcctcagcctcccaagtagctgggactacaggcgcctgccaccacgcctggctaattttttgtatttttagtagagatggggtttcactgtgttagccaggatggtctcaatctcctgacctcgtgatctgcctgcctcggcctcccagagtgctgggattacaggcgtgagccaccacacctggcccacatatagtcttgaattagagtaagggtgtcccctccatgagacatgcaaaattgcatttcctgaaagtctggtagtgagctggctgacaaggtaggacgacagaccatgaggtccttgaagggttgtgtcttagttttcagccacagcgcttggtagaatgccaggcacatggtagatcctattaaatatccattgaataaaatgaacaacacttcgggtgcatcaagtgtatccagatttaattgaaatttttgccatgagactcaaacttggtttccaagatgttgactcctgagtcttactatattctctggagttctggaacctgtttggtattcggagagaactttcctctctccttttatctcctgtcaatatgcatttagtacttgaagaggttaaactgtcaatttcgcatgttatatatcttgcaacttaattttgcatgttgtatatcttgcaaccaggtttaaggacctttggagcctagaagaataaatgcctcacacacagcaaggtcacagcaaaaataattaatttatttattacaacaataaagggcaaatcataattcctatgttttctttagttagagattgtctaactaatttttctttcctttaatttgagctatattggatcagtttgcatttttctgtatgctttgaggtgttttctcacgttttcttaaaatagaagatccagtctttttcaatatctatccctgctttcaccacattaccccttatataggtgcacacaaagggaccctcatttgaatcattgctaatggattgattattgtggattgtgatccaattctccacaaacctgatctttaaaaacattccagttgtctcatgttgccaataagtttctaactagcttgacttgctactgactggacacctttcagttccacagagaagaatcaccaactcatactgggtacctgggtacctgggtgtctgaaacacccattaaacctgttggatggatggatggatggatggatggatggatggatggatggatggatggatgcatggacaaatgaatgggtggatgggttgtatacttggccattctcaccaagacaacatacatggacagtctgtctttaatacatttttccaagaatttttataaggccagagttggaaagagcccccagatttatctataacaatctgggtatgacccaggaatctttacaacctccctagttaacccagtccaaagtccatgagctgaaacttagtgtctgttgatctgcctggcttctttttctcttagactccttgcctttctttctgtacattttttcaatcttttgacggggcaaagggaacatggctcctactgtgggaagggttttagttgaaataaaaattattcatattgagaaaaaccagcaaatgctaattaggagagtgacagaatcttcccctaagttttaaatacacacgcacacacacacacacacaaacacacacacacacaaagacaataagtggttcctgggcagaaagctaggagggttggattagccctccagtctagtccccaacctccccaagcctcctgtagatggacaacaagggtgctccccttcttcccagcctgaagccctactcactgtagatggtctgatggggtgcgccatccacatggccattcttgtggatctgcaggtggtagctgttcctggctgtggctgtgtacaggtggatcaggccaccccagctggagccgagcagtggggaggcattgggataggctctgaggacgctcatgctgcagacgctgcacaaggcacagacccagagcctgaggcgggcccccaacatcgtgccctgctctgagtggctggtgctgagattgaaacctgacactcctgtcgggactctcctggcccaggccttactggccttttccttctcccttgcaagtagctggtgtgaggatcctagactggattccctcctttttgccgtcagacttttaaagggtagcagtgtgacatcaaacaggaaaaactccactgtccacatcctctgtgttgtaatcagcccattgaaagaaagtgcaaagaccccggaggcgcacggaaggcacgtcggttccagacacacacacccctcaatttcaagccaacgctccaaaaaatgaatgacgtgtgggcaaaagttatctgccactctgggctgtctgttgacctgtcccacttccatcaggaaatgtgaaggcagccagcggttcccaaaaaaaatccagcttcagtcaagcagtcaaccgactcctaggcaattaatctcctgtcgagtttacttattttggttttctttaaattccaatcagcaagtatgtatccagtgcttaatctgtgagcaggatttggtgggtagcttgcaggatatagagatacatgacaccatcaggcagatggcatcctctaagaacacccacttcatgaaagatgggagctaggagcaggggcacaaaagccaaagttgccattttgggaagattttgaaatggaagaaaaagaagtaaggccttgaggtcagtgaacatgccaaggttcagtttctcagcttccttagtctggacttcactgaatatgccaaggttcaatttctcaatttccctagtttggactatcgagggcaactaaactagtagtctctccagtagtaaggagactcattcagagacctcatggggattggaacagctgctggctgagcactggggatccgagcctcaggacagggtgtccccacatttagtgtctgtacatgagtgctcagcttggtgttggatgcctgcctgcagatgctgttcacagtgagccctctgggaagctacacctgatgtcgggtggaatagtcctggcacatacagtctaaaggggagcaagctactggaacacacacccgaaaaaacacacaaggagtttgctattcttccagtttccctgtactgagtatatgccatgtacaggcatcaagctagactcatgtacaggttgatataggagacagcaagatgtgattcctatcttgaggagctcaaatctaatgcaggaggcagataaaaataagtaactataatacaaaatgagtgcaagcttacaggtatagacagaaagagatggcatttgttaccctacatttgtacagtttttttttatagtttacaaagcattttcacatctattagcttatttgaacctcactgccactctgtgagataggcactccatgcattatcaagattttaatactttacatgaagaaatggaaatcttagtgtttccatgtccaaaggcacaaagcaaataaatggtagagccaggacaaggtcttctccttccctaggctgcttctccaaagaatcacagcaagaactaacgctcatggagagcttactgttccacttactgctctaagtgctttacttgtagtaacccatttcatcttcagaataactctttgaggagatgctgttattttctttatatagatcaggaaactgatctatgcacacagtttaagtaacttgcctagagatagaaaggtaacatgtggaagaggttggatttgaatccaggtctggccccaagacctcctaagcacttttcaaggtgtccaaacccatacaacatgttagagctaaagccatgagagccaggagcttggtaaaaaagtgcaggtggcaaagcagtcctctgttattctctaaaaacccaggcttttacccaggatgaatctctaggacacatggtgcttgtctccccagggttgagtggaagaagtatgacatgaaatgtttatatgtaaaacagtcttctttactaatagccacagaatggattataaatataatgctacgtcttagctaattgaagaaatagctagctttcagaattgagatgcaaatcacttaggaacatttgccctgcatttcttattctggttgtgaaaggtaaagagatgggaagtaattataaggcaatcagcagccattgagaaccttctccatgtaagagatgaaagggagggtgtaggactacaaagcaggactaactcctctaggggctcccagtgtaactgagcagggaacatcttcgttcaatacaaggcactgtgtgggaggagcttcattactaggagcaaattagtgaagatgtggtactatatttataaaccattctgtggccattactaaagaagcctgctttatacataaacatttaatgtcatacatcttccaaacaaccctggggagacaagcactatgtaccctagagattcaccccgggtaaagacctgggtttccgagagaatcatggaggagtgctttgctgcctgcacttttttaccaagctccttcacaaaaaagaaatgttgaccaggcgtggtggttcatgcctgtaatcccagcactttggggggccgaggtgggcagatcacttgaggtcaggagttcgagaccagcctggccaacacggtgaaaccctgtctaaaccccgtttagtagaaaccctgtctctattaaaaatacaaaaaaattagctgggcgtattgtgtaatctcagctacctgggaggctgaggcaggagaatcacttgaactgggaggtggagattgcagtgagttgagattgcaccactgcactccagcctggatgacagggcgaggatctgtcaccaaaaaaaaaaaaaaaaaaggtcatggtgggtagatgctgtggtcaaggagggctttgagggaaggagagaactgagggagctttgtaggatacacagagaagggttttccccagcacctgccaagcatgatggagagggagcacaggtgtcttgggataagtccacagccattcggtcattcccctagctcctggagcgactggggaaggggctcctccgtggccacctcagcttgtcttattaggaaagagagccctgtgccagcttacccaggtccaaagcctcccctccaagaagaagccctgtgtgcttagcatctggctctaatggcagagtccagcccagaggagtagacttatttttaaggaggatgggaggagaagcagcatttcccacttagagagagtaaaggaaggcgcaagaatctcagattaattctccccatttgagatagggaaacactgagagcggagatgaagatttgcccattggaacacggagacagcagaatgtccagctccaggctgaactccctaccagtggcttccaaatctggctgctcactggaattacctgtggagctttaaagccataattgccccaggactaatcttagacctactgaatctgcaggggcaaaagtcagttatttgtactttattcaaagccacctgggagattctaattctccacaccagatgtggctgatactaaagtacttatcaataaacaggctttgagcgccaaccacacatcaagcactggaaatagtacacagagactaaggccctcttcagtggcaggctcaactttccgttcccttctaggatgtccatcctaactgcaggtcaagatgtaaatgggcctttctagggaatttagtactgaatgctaaatcagtacctcgtgctgacaagtaccctgtccttgagtccagtgcatggtctcctctgaagcttcagtgggtaagagaagggagaggccaggacatgtcggttcctgtcctttgcacctagagggcactcctccgtcacagttcaggtccaagggtctgggaaccagtgtgaccttaggagcccaaagagaaacacagatagataccagctgtgaacaggaagcccagggaggaggccctgggtttgtgctgtttggacgtcactgtccttggttcccaggtagctacctgaatgcagcagataggctggtcccatggcaggcagggaaacctgttgtctccagcctggtttggaacccacttctctggcattaagagaatttgccccgggagctgtgtggaagcatcaagtctagtccctgcatttacgctcatagaatcaaggctcttagtatagataagggcctataagaatctgtattccggctgggcgcagtggctcatgcctgtaatcccagcactttgggaggctgaggcgggcagatcacctgaggtcaggaatttgagatcagcctgggcaacatggtgaaaccctgtctctacaaaaatacaaaaa

SEQ ID NO: 416 - DNA, 8000 bp, Homo sapiens
  Locus number 28 genomic DNA region, deoxyribose-phosphate aldolase, phosphodeoxyriboaldolase, deoxyriboaldolase (DERA)
ggcaccttctcctctagaatccccctaccccatctgtggtgaccaaaaatgtctctagactgagaaacaatgctttacggtgaatcagaaatctccacttatccattagggttgttttagccaactggataagcctactgtgacctacccttcctctgaacttgactttttatccagccagtgtggtaagtttttatttttgtgtatgaggaacaaagttaaaatcaaaatagaaaaagcgcctccttttgtagggttatcatttggtgttacatgctttaggaatactgtgaaaaatacaggaacttctgcagaaacacaaatgaaaatgatggaaagtctagaaagtaaagttgcagggaaaatgacctccatctccactacgacttgaaccagaaataataataataataaattgtgagaagagtatttgaggacaaatttataaccaacacaagggcctaaaaaccaccaaaatgacatattaaggtaaatagtgggacttttttcattggagaattttaagagaagatatcattgccttccaattatggtttcatatctgttctccccaaaggcatgtgtacttaaaacccctcttggccccataagaagattctttggtcctgatgagattatgtgcattagaatcacttctcctggaaaggagacgctaaagggtacttgaataaaatattaaaaattatggaggacataacaaaggccaatcagtcctttcttttccccagaccccataataggagaacatgggttatttgatgaaattaaagagtagcaaattaagtgctaataaaacgagatagtcacttacataattcattgccatgggaggtcacagaggcaaattttgtggctacattaaatatggggctggataattttatgaccgctaatgatatttttagcagtcaaggctgatactgtgagagaagaaatcctattacattctccagtagatggtttgcagggacctctggcaagaggtttctgagaagtgcaagagcagaccttgtgagttctaacctttggtgtactcaaaattggtttttaaggggaaagttcccaggcatcccattcatacctcagtcccatattttcttgtagagatccaaaagccctttctagtctgaagcagtggagaaagacattgcccagaattaaatcctttctggtctttgggaaccactcgacttatttatcgtatgccacccgtgcgtcaggtccttcgcttggagttttaaaaaatcttttggggacataaacatttggacacatcagtggcattctgagtgaaggggatgtactaaaggtggaatgcagagtttcatggaagcacgaagaagcaaagggatgtctcaacctgtgaggttcagggaaggctcccagagaaggtgacatttgaatcgactcttaaaggatgagcagcagttcactgttcgcaaagcagggagggcattcttggtagaaggagcttgcagcatgcacagatccagagacagcctggcataatgtgtcagggaactgccagtagtttaggaaggctgcaccacagaggcagaggagcagtgagggaggagctggggcttgagaatgaggaaggagccagatggtgaaggaagaggcttgtgtttgcctgagacccctctccaacagtggtgccagtgtttccagtggcgacagtagtggtagtggtgcgttgggagtagagaatgggaaggacttcaggggtgtcctgtgaccgataaaggacagcctgtcaaagccttgccccactgagtaataggcctacctctttttgatcacggtcaacaattagttggcagtgagtcttggagttcacatactcttcactcatttttctatatctgcttgaaacagtctttaccatgaaccaaatcagcattatcaatcatctgaggagaaaaaaaaaaagcctcttagggctgggtgcagtggctcatgcctgtaatcccagcactttaggagggcgaggcaggtagatcacttgaggtcgggagttcgataccagcctggccaacatggtgaaaccctgtctctattaaaaatacaaaaattagcctggcgtggtggcgcacgcctgtagccctggctccttgggaggctgaggcatgagttcgtttgaacccgggaggtggaggttgcagtgagccaagatcgtaccactgcattccagcctgggcgacagagagactgtgtctgaaaaaaaaaaaaaagaggctcccctgcgtttgagtagggggtgtttcttacaggtcttagataaattgggacgaagtctagagtgtctggtctgattttctcgggctctgctagaacaaaaacagcccttgagtgggaaagcagaggcagatttcatcggcctgaccccagactcccattttctctgtgaagttggctcagcaaacaagcaagaaaacatacaatatctttgaggagcaggagcagatggattgaaatgttaaaaatctggtttgttaaatgatttcagctaacaaaataattagagagaaaaagaagcacccaaactctcttccttcttcagtgaaatttaaataagatcattattaatcactcagagtccaccttgcaatctctatacctttaatactgatacttttaagaagaatgaaatgaaaatgagtgagagaaagaatgtcatctgtaaacattagtttagatgcaaatacttcaatttgtattgttacatgatacagtatgtgattagcagttttcctcattgcattataaagagttttgtaattagtgcattttttctaatggataactttttttccacagtactcttttaaggctcttttaaaaacatggaattgctggagagatatagaagtgaggttagttatagaaggtaaataatgttcatgtccgatttaccgtgaggccacctatgtttataggatattggtggatgaagttgaaatatgtgtaccaaacactgttggatgttagacacccaaagatgagtaacatcatggctgacaatgtactaagtacaacgaatggtttcaccaggaatccttgatgaattgattacaagttctgtggtagagatctatccaaatgttagctctgtctggggagctgacagtgttttcacaacagctaatatttagactaggtctgaaggtagaaattacagttaactggaagagaagagagagtagatcaaggtaggagagagcatttcagaacaaaagcaacagagatagctcctgaaactttaaataatttgttttttctttttttctaacttctgttatatcagtcaatgttgttatttctaatacattttgaaaaatttttctttgaagaaagaatgggctgtatcctgtcagcatgcagtaggtattaatcttgccagtaagcgggtagtgagcacagattctgtaagccccaccattagttcacttaagatttgttaatcatttgctctcctgggctggacactcaccagtaagtctttgctctcagaggtgaggtacgtggcatgggtaacacacatttcccacgtcgttagacatgtctgtgtgatgaatcaatacaggttcttccagttccaaatgtataggctggtacagaagcaattgtggtttttgcctttgaaagtaatggagtgattttgcatgaagtatgccttttgttgactggtcttccatcaataaggttgtttatttatagttgtacaaaaaagaaatataagctttaaaaaaaggttgatgtcaaatgataaatgtatcctttcaaggaccatgtaaaaataggtgactatatttaatgaaactttaggtttcagaaagtgtttttctgtctgttttagaccttagctggatctccaaaatacaagtgaatcacccggcagttctgaggcgtgcggaacaaatccaggctcgcagaaccgtgaaaaaggagtggcaggtaagggttcttcttgagcattctgtgcctgtattttacaatgcatggtctcttccctcaaggccacaatattgaatttcactcaagatgcatctaaacttaaaagattgcagctgtccatgacttattttaataattcatatatgatgatgatgggttggagaaagataacacatttatccaaacaagttaaaatcttatcactcttgagtggcaaaaccgcaaatgaatttgaggcatctttattcatgagtgaattaaatggcatattttctcaacacatttattcagttttttagacatgccttctttggttgtcttctgttttaattttaaagccctaacatctaaacttgatgtgtccactgttgaggcccttaggtataagagttgacctttcttgaccatcatatttaccttactattactttctataaatcatttttcaaaattccaaaaatgatgtttcgtagagtacttgcggtcagcattttcttcagtgtatcccaaccaaagacgtgctgtgtaggattaaagggaattcagagttcatttcacaagtgagacagaatactgtgattgaatccttgagagtgatagttcacgttttgctcatccttagaaatattctggttgaaaaggtaaaataaaattcatcagactgagttgtgaaatatgaatattgttttaaaaatggaattggattaaattgaaaaaacaccaaaaaacttggaaacttttaaaaatgataatctcatcccagatcccagagcgggaggtaaaatgtaaggtagaaaccttctttcggagttcttctttgtcagggtggctctgatgggctctccctttggctgagatggagtagtcagaagtggggagacatgggctaataggggtttcaatttgggatatctgtgggagaaaaaaaatgtttaagcctactcttcctcccttttattttgggcagtgttcaccttgttagtggctcttgagctgtgtttatatcatgtatcaggatattccattgaacagtgtaggcataagatattaacacccatacttgtctaatgattctctactaaccacctgggttggaggttggttggtttgtttatttattaaatttactttgttttcacttttgtttaaaccaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggtaatgttgttgtgtgtgatctatgtggtgtttagtgcttacaatactgattactaaatcaaagacgacttaagatacagctgctaatgatagcggtgatagaatccatgatagaaactcttgctgtgtatacatagacagattcttctctgaaaaacagcaggaagagaatctgagtctttttttttttttttttttgaggtcagttctttccatcaatggattaaaatgcttggtagagagtgactttatttcttttcagttcttcagttttggaaaatttctgtttagtgacactgaaatactctttctgattccctagccatacgtgaaaaagccagtctcattacttaataatcacatctcatacataaagtattttctgtgagtatatgaaatacttttgaaaataaagtgcaaatgagaaatatagcctgcttatatattaggttagatctttcaaaaaaagtcatattcactgccttagtatacatgaaaagaaggacttttctagagttgccataagtttagaaccttagcattttggagatgttggacacctgtaagaattgattcccttgttttctaaataaagaaacaaagacctggaaggctaagcggcattcccaaggctacacgtcttgttacttgctgggctggttttgggagccaggtctccttcccatggagtatgcttcatggcccccgagtgcctatctgctgtgagtgcaactggagacgttgaattggcccaatgcaggtcttttatcccaaataaacacgtttaggtttgtaggtaacatacaaacctaaacaactctacggcttttgaaaagtatttattatgtttatttcgtgttggccataaaaatatcaccttatttattgcacttaaaggtaacaacttgatgtaaggtcttatgatattgctttgttttatagtgactatttgaattctaaattttttaaaatttatgaacttatttcttaaaatcagggcttccgtttcagattttattatttcttgcaaaagagggaataggattagttaaatgtcatttttgtggtaccaccctctaaattgtacttatatttgtcttcatctgtccttcttcaaactgtcctttcttcaggtatgtcctatgtgaatgctctgtaaatatggattttgttatctacatgaaatatttgcatttagtaatgatcaccaaatttactatttagacatttttaaaaaacagtactatgttaatctcaaagatgagtatatcaaacttgtttttatgactttaacgataagaaaataatccatattgtcaagaactagaagggaatgtggaaaataaaaatcttttaatttattgcagtattgtgggggaattatttttttctcatttgatttttgccagtgttgcgatataaataataattaaaagcatgttgtatgagttgaacttcattgaaagttggctattcctattttttcttgataggcattactacagccgccgtttgtgtttatcccgcccgggtgtgtgatgctgtaaaagcactcaaggctgcaggctgtaatatccctgtggcatcaggtaaaatgtgttgtggcttttgttgttattttttaaacatgtttccagttcttcatacaatggggtattatatgtaggtttgtactatgatttaaattagtttatgtatttaattagttgtatttattcatgattttagtatgtactaattgcttagtaagtggaagacatttattcccaacaatatagaactgtattcctatccttaaagaaactcagtttaggaggaatagtcaggtaaagaaaaaagtcataaggcatgacatatagtatatatatatatacacacacacacacacacatatacatactatatatgtatatgtatatatacatattaactatatatataactatatacatactaacacacacatgtatgcatgttctgttatacatatatatgtaaaatataataataatgatatgcgggctggggacggtggctcacaactataatcccagcactttgggaggccgaagcaggtggatcacttgaggtcaggagtacgagaccagcctggccaacatggcaaaaccccatctctactaaaaatacaaaaattagccaggcatggtggcaggtgcctgtaatcccagctgctgggaggctgaggctggagaatcgtttgaacctgggaggcagaggttgcagtgagctgagatcatgcccctgcactccagcttgggtgatagaccaagactccgtctcaaaaaaaaaaaaaaaaaaaaaaaaaaacaacgatatgtgcaaaatgtgtagttgcggttctgagcagggaatgatatattctgcagaggttggtgacaccaaagtaagagaaagcatcgtcgtggagataattgcattggatcttaaaggatgaggaggagttcacagtgttaataaggtagggaaccacatgttagacagaggcactagcacgtgtgaaggcacaaagcatgttcagggaactggaaaaggtttgctgttgttgactacaaaggcagggctctgaagacagggcaaagggggagatacaggagttgaagctagagagggagatcagggcagaattgcagaggggatccatgccatgtgggggcatttggcctgtattctgatgatagggaagacactgaaaggttaga

SEQ ID NO: 417 - DNA, 8000 bp, Homo sapiens
  Locus number 29 genomic DNA region, similar to RIKEN cDNA C530050O22
ttgagaggaaagcatttgctaagaggagcacaaaataaatgggaaatgaccaacaagcaacttatataggtctgtctatatcgtgacaaaataaaattctttacaatcaagagccaagactgtcagccattctgttagattttgctgggaaagtggcaccactcgggaatggctgtaatccaacctcatcggattgctgtctcctcttgcctaagatttagtgtttaatgttttccgtgcgtcccagcttttctctgcataaccctctcctgttcttggtgtaatttgtagaatcatgagatctgaaacttgagaacttcaaaataatctaattcaattattccctttaaaataaggaaactggttgggtgtcgtggcacacacctgtaatcccagcactttgggaggctgaggtgggtaggatcacttgaggtcaggagttcaaggccagcctggccaacatggtgaaactccatctctaccaaaaatacaaacattagccgggcatggtggcaggcgcctgtaatcccagctacttggagactgaggcaggagaatagcttgaacctgggaggcgagggttgcaatgagctgagactgcgccgctgcacccagcctgggtgacagagcgagactccatctcaaaataaataaataaataaaatgtggaaactgagttgggtcccaaagaaagcatgtgatttatttttcatttccatgcagtggctgtgtgggcagatcatctccatccactgccactgatgtcaggctgcaataagcatgcttgtgtaccaataccttggttatctgcatggtcctcatgacaatgaaactgtcctattaacctacgctgttaaacaattagacctcatactcagcatcacttatggattattctggccaaaatatttaacttgaatctgttcaactctttagatctaaagtcaagtttataggaagttgaaaggctaaaggaacaatttagaggggaaaaaccacacaaatcaagaaaatggagcattttataggataaccaatttttttttttttgagatagggtcttactctgtcaccctgcctggagtgcagtggtacaatctcggctcactgcaacctccaccctccagcttcatgtgattctcgtgcctcagcttccagattagctgggactacaggtgcacgctaccatgcctggctaatttttgtatttttagtagagacggtttcgccatgttggacaggctaaccttgaactcctggcctcaagtgatctgcctgcctcggcctcccaaagtgttgggattacaggcgtgagccactatgcctggcccagggtaaccaatcttacatgttattgtctttaccaatcaatatataaagtaataaaaaaaaaaaaggaggaaggactgtactagattaaaggaagcttaagagacatgcaactgagaatagcatagtccttgattaattcctgggttgaacaaactcactttaaaaaatgttttttggacaactgggaaaatataaatgtggactaggtgatattaaaaaattactggccaggcgcggtggctcatgcctgtaaacccagcattttgggaggctaaggcaggtggatcacctgaggtcaggagttcaagaccagaccagccaacatggtgaaaccccatctctacaaaaaatacaaaaattagctgggtgtggtggtgcacgcctgtaatcccagttactcgggaggctgaggcaggagaatcacttgaacctgggaggtgaaggctgcagtgagccgagatcgtgccattgtactccagcctgggtgacagaacaagattccatctcaaaaaaaagaaagaaagaaagaaagaaagaaagaaagaaagaaagaaagaaagaaagaaagaaagagagaaattactattaattttgtcgtgcatgataaaggtattatggttatgagaaaatgtcctctttgttttattttttcctttcacacctagtcccacagaattgtcttcttttaaaaagatacatacccaaatacttatgagtaaaatgtcatgaatttcctttaaacttcagtaaaaaataaaatgaacagatgaaataaatatagtaaaatattagttgttaaatctgggtgatgggtgttgtttgaatgttcatcttaatattcttggttttgtaaaatgcttcataataaaaaggtggggggtaatgctcctagaagtccttttaggcaggtcacagagggccaagctgtttaagaactccatgctgctttgaccaactgaggcatgcgtgcctttcccaaagggcaggtgttgttcatatgactttccactgtcttttaagcagtaggtagtggcctggtgcttcccaagtagtaaacatcaatgacagatttcaaatatatattgtctgagaaaatctgcattcctcaaaacaagctaagccatctcagctcccatatcatcaatcaacctatagttcagagccaaccctgaaagggctcacagccacttgtattcacctcttactcattactataccctaggattttaagtgacagattcgcaaccattaagtaggaatatttcctagggaaataaaagcagtgatatgagtatgcttaaattcaaaagcctagtgagaattttatgattatgaaaaatttaaatcccctctccatctagtgctatcataaatgaaaatagacttttggagtggttttccttctaggagtcccagaagcacttcagttcccagtcactcctctaatgggcagtagctatgtgactttggacaagtcttggattctgatttcgtcatcatcaaagtgtaacagcccaactagataatctctaaactaatcccttgtaattttaaactttcaatgtgtccacatggcctagtggaaggagactggactagtgatgtaggcttgtatcctggggttgtcccaagtcaacatctccaaatttaatgttccttatgtgcacctgtagataatgatattgacctcaccagctttcagtaaaatttaaaaagagatgtcatgtgtaaaaatttcaggtacccagtgcctcactaaatgttagtagactccgaataatactcaacttatgcaaccctacttagctttcctggtgatgagcagagttaacttcaaagtgccatggccaggccgggtgcagtgactcatgcctgtaatcccagcatgagacaggtggatcacctgaggttaagagttcaagacaagcctggccaacctggtgaaaccccatctctactaaaaaaataccaaaaaaattagccaggcatggtggcaggtgcctgtaatcccagctactcgggaggctgaggcaggacaatcacttgaacccaggaggtgcaggttgcagtgagccaagattgtgccactgcactccagcctgggcaacagagtgagatgctgtctcagaaaaaaaaaaaaaaagtgccacggcctggtaaccttaaacagtaccagaccttgctcattagctgcagggcccataagtcagccatggcgtcaagcacaccaaggtgaaagcacacattgagttttccaccatgttcccctggctttcctgtgtcctgaatggaggatgccaagaagggccttttgttaatttctgcttgagtcaatccactttctgcttgttctactgccatggattgtacccttagctctagccagctggctggagattccttgttactggacacaggaaaagccagacagagggtcagtttaaatctgtcagagcgcctagaaaacaactcgactgcgcatgcccggctctccgtggggcaggagaggcaccaaaggccaccccagggaaattctgacagcagcagggatcaaaaccatcatggtggggataaaaccacctgctgcttgcacacaccattccgttagcatatgcacctgcagtaatttaatgccccacaggccctcacccgacagctggcagccgcctgcctccagcttcaagtcacacccgacgccctctcggtagaggagctcgattccgcgcaggttctccctcagctcctctgcctggctgggcttctttacatcttccctggcatttccagccctctcgcatgtctgctgggcagcagccttcacccggggcgctcccagcgcctctgctgcggccagcacatccccctgcgaggcggggcccagcaccccctcataggcaaaggtcagcacggcctcccagccccctggggacacctcgaggctgaaggggggccgcggacctccgccgcccagcagcctgtctcggaagaggctgctgattgcggccaggatcacccgatgcaccccgtatacccgccccgcgactgacacctcttcgtccagcaacagtctctgctcccgcagccgctgggcctcggcgaaaaactggctcggatgctcctcgctgcgcagccactcgggctctgccgcatcttcatcttcttcctcttcctcttcttcctctagggacaaggctggaaagggaaggttccttgggaccaggggcctggaaccaggctcctccagaggaaaggaaggcaatctgggatcctcgtcgggggagggaggccaggaaggggttctctgggcgtgcacaaggagtccaaggcagtccctctggacgggatgagagacactctccagctcagggggataatgtggggtgtccgagacgctcatgccgaggtttgctggatagctgcaggtgagcagaggcaagacagcctggcgtcagagctgggcccaaagaggccagagcaaccatgtctccagccagttgaaatgtcagtctctcccctgctccaacaccctcctcctaccctcagccacatcccagcactggagtatctgggatatacaggacagctatagggtgcacgcggtgcagtgaaacatgcaagaagccctgtaaagatccggtaaccgggaccacacccctcccctattgcccccatccttttagtcaccctcaggagacaccagcgttccgcttgccctctcacttaagcgcccgctgtgcttggggctgcgtggcagagggaacttgcccacatggcatcccagtcagccagtggccccatggggctaattatagccagtcctggctggctaggcacttggcacctggtgtcctaactctgacacccaatcccctgggctccctcccagactgacatccccacccttccacctgtaggtcatacaggagtgtgctgagctaggcaaattaggaaaccaaggagaatgaggggatctggtggaatgagcccaaggccagaagggctgggccactagagtgggctggaaggatcaggcaaagagtctggaccaggctttggctgttgacttttctgtgcatgataaagctgggaccccgccgggcatggtggttcttgcctgtaatcctagcactttgggaggccaaggtgggtgagtcactggagcccaggaatttgagaccagcctgggtaatatgatgaaactccatattttttatatctaccaaaaattacaaaaattagctggacgtggtgtctcatgcctgtagtcatagcactgtgggaggccaaggcggatggatcacttgaggccagcagtttgagaccaaactgggcaacatggtgaaaccccatctctacaaaaaaatacaaaaatgagccaggcatggtggggcacatctttagtcccagcttcttaggaggctgaggtgggaggatcacttgagcccaggaggcagaggttgcagtgagctgaggtcgcaccacacactccagcttgggtgacagagcaaaaccctgtctcaaaaaacaaaaaagctgggacccaggagcgaatatagcccagctttattcatggagggcagaagagtggggaaagtgaagggccagggggcagggctacggacctaggtggctcaccccacacagggattactatctgtccagaggtggggtccagggtaagagcctgaaatccaaccctgtgtctttggaaaagtgtggggaattctaactctcatcttggcactgggataagaaccagacagtggaaggtgtgcttgatctgcatgctgtgaggaccagagtcctggactagatgggctatggacatgcaagtattccatttgagccagacggtaacagccactccttctccctccaggacaacacttcctttctcatcctgaggccaagtgctagactaaagcccctaaaagccaggcaatcactttgtgccgcagttttgagtgtcatcttgcagaaaggatttagggaaaggtgcagtgacacacttcctctcccttctctgggggaggtaggacaggccaaggactcctacttcctggcctataaaatgtctggtccaggctggataggttgactccacaggcagacttaataagggaaggaggaacgattgctccttgtgattcagatgaaagggctcatgtggagggcggggtagggtgggaagtgggctgacctgcacagcaccccctcctactttcagagttgtctccatttccccatttgtggcctgggtacccctggcaactctgagtagctagcattccctgggtgagcctagccagcaggtgcactccccaaaatggttcgactgagaggcagtttatggttatcctggccagcaaatggggagatagtgtccaggctctgcaccctgtttcccagttcagacatttcgaatgcctctcatgtcctccccagagcaagacaatgtggccagcatcttggcccccaaccaggagttggaggaactgcaatctggtggagacataccccgagccagcctctgttcaccaactgcttacaaggatgaggacactggaccctgctacgagttctatgccaactccgtagtcctgggatggctccatacagcttggtaagacccaggccccacagtgaactcctgaaggtaggataacatctgcctgtgggctaccaccacccttcatgtagctctgggactgccctccaggtccattagctgtcctcctggttgcagacgcgctggctagcaaggggtcttggcatttcagttatgtatgtgctgtcccagccaagaaatagtgccacgtccacctcgagaggaaacccacacccagccacactcccaagatgatctggagaattctggggccaaaatcggcaaggccccagtgcacttcagctgggtcataggagtcatggtaatggattggcgctcatggttccctaagtctggggatctaggcaggcgagaactctttgctccaggggagtttttgggaggtacctctgaagaagggggcaaggggtgggactcacactggagactgcaacccctcccttaccaccccgctccccagatttgctgtatgctcaatatctggggcatcattctctacctgcagctgccttggatcgctgctcaggcaggcacaggtatgagctcagagctctcctgggcagtaggaagggatgtgcatgtatgaataaattcccatcctcaccccagggctcacatggctcatcatcctgttcttggcctcagtcatactgtcactggattgtctatctcagccatctccagcaacggcaaaatcaaggctggtgagtctgtagtgactcccgctcctcccttcatgtttccccatccctcatatctgttaatgaattgtatggtgttcttcgatgatcacatttggtcatttcctcactcccccaacccctgccacacaaacattttcatttccccttttggtactggtggtacctagatagccctactgctttgggatggggttttcttcccatgaagaaatgtgtatcctcaatctcatttctaggctcctgtatgattcaacgtgcttccgaaaataggactgacatgggtgtgcagaatgggagccgcctgggcgcaaagtgccagtatggctgggatttca

SEQ ID NO: 418 - DNA, 8000 bp, Homo sapiens
  Locus number 30 genomic DNA region, Feature name CHR14P093230340
tgtcgatgctgaacatgctggcgggcatccccgagccccgcgtcgggaccggggggcggcgggaacgcgccgaggacagagccttaaagtgggggggtccactctcctccagccgccgaccaaaccgaaagagagcgccggcgagcgcgcagccctgcgcccctccccgccccctgcgtccgctctccctcctcccgccctcccctagccgcagcgttcgctgaactcaacccgcgggtaggacggagctcagaccagctgaacctcttgttggttttatactgagtcgacgtcatcctggatttagttcctggtaatatgcagatgacaaacagaaccagatttggccctttcttttcctttgggtgggggaagagggttggggggagggggagaggtgccaaggggagggggttacaaggcctgaaaagagattgtggattgcgaattaatgaaattaacctaatcttttccattcggcagccgggccgcgggccggccgagctgggcgggcggcctaattgccttggttaatctcattaattcctttgtgccgccgcagttaacaactccctccgcccgagctctccacccccacccttttttctcagattgggtcctattattgggtgcgatttcctctgcctgtagctcaaattcattgtggacgattttactttggggctacttttttccccctttcggaattggttttgttttagaaaatgtgaggggctgcatcccctctcaagcaggattgaaaattccaccactcctccgcgcccccacgtactcaccgcctgatttacctcttttttaaatcttgagtttctctcccgaatggaacttgttaacccccccaaaaaacttttggttttgtaaaatccaaattttgtaaaggcaaaaacgactaaaggaggggtgcatcgtgcttcttaaaaagatttttttttccagccactctgggtctgaaaactaccatggcagtccctaggtcctacacagcgaagaccaaattcagccgctctttaaaattcgccaccaagagttgcagtctgaagcggtgcttctagctgctcccagcgtgggtgtcggtagtttttgtgcttttaaaaaattagttttggaaatgtggtgccttctctcccaaactatttttttgattttcaatccagatggggtctttgggacttccctatcttcttccccaataattgggtcgcatttttccttacgacctgctggctgccggtaggcctgcccttccgcctggcaggcccagagtggattccctgggccgcagtggcctggacgatggccgggtctgatagcggcaggcggccgcgatgatttgcgggattctcggcatggcacggccagcctgcccgagccacgggaggcgcagccagcccaccactcacggcaagcaggcggccgagcgcccttcgagaaggtaggcgacggtacgcgcggaacaaaagcagtcccccagatcctgtggaccgggtgcaagctcccggcttgcaactcaggccactccaggggaaggggcagtacccgacccaggcgatacccccgagagccggagagggagatggggttgcgggagacctcgggtttcctgaaggaagtccgcctttaactcacacctatttttcgcgatttctctcaggctaattaaccaagggaccccgcaaagttgtctgaagtcgccgccgtaaggctaagtaagtgggctgcccactccccggctcaggggcaaaggggaaagcccacttgtcaatttctgttcgggtttcaaagagccattgcacggaggtttagtcctgtccgagggcactactgtggcggcgcgcagaagcggcccagtggagccaggcggcgacgtttctcctcctaggcctcccagcgtggacctctgtgtcctcacggccaccagcttgtggcctgagagttgctccttccagtgctgcgcaaactagaggtggttgtaaatggggattaggacatgacggagatgggtctcaatttggggaagtgaatagagttttcctttttttcttttttaacaataaaaacaaagagggagtgtgaccctccccttagagaggtcaggtctagggtaagaagtgaggcaccttccatctcccactgactaggatgaagtcttttttattgttgttccgttctcagagacttaagtcaccatgctccagggcagatactcccccaccaatctttcccaggtttaaagctacagggcagttgatggacgacaactagaggctgcaacttatcagtgactgcctgcgtttgtgttggaggctgggtgtgcgctgcggtgcgcgtgtgagtggatcttttaagacctttgtctgagccgggcagaggcacaagtgccacctgacgcttggggcagattcctcgtcctgttcttgcaaagatgccaaatcaggagagtgtcaagatttcaaccgcagacctaaaaaaagtgtctccatgtttttaaaagtatcagacaaccacctccacacacccctccgtctccccttccacctggaacattgttctttttaataaccaggtttagcaaactgctatactgcgcctgtgctttcctgcagccctccgctgtaccagctgagccctgtacagaatctgagcgtcagagttgcagacccaaccttgccaccttgcaaatcatcccttctctggaggcctcaggattttagttgatcaaaccaacaccaacattcattgggtccctttgcaaccctaacatttaatgagacttggtaattgtcatccgttcgccaaggaggttggggatgaacttgggggcattttcttgtttatttttcattgagacaaaggagtgtgctgtccccacctccgcccccagacaaggacagggttcctacatcagctgggtctaaaataaggaaaagcgagtgctgccgcagaggggactttccgggaagggggtcacaggaaccccaaggccacacagctccagacactctgccggagctctaggggagctcacccctgcgcggcgggacctcccccatcgggttgccccttcaatctgcagccgcgcggaggcaggccccgggaaaggcagtcggcgctcggtgctcgcactgcgcctcggcgggcggaaactcacaagtgtcctcaacgtgctaaacaaaccatcagggccccgcatcgcctggcgcaattggaataacaaatgcgacgcacgcaaattgtccacctcgtgttgctaagcgattgtttgtcggccccgcacgcacagctcagcatgggaggaccgcgagcgtccagaggcagccggcgagcgcttaggtcggaaatgcagtaaacatgccgctgattttccctattatcacccaaacacgatttcacacaaagcaatcaccacgcagaagtctatgaaaatgtgtttgttgaggagtcactcgccccagtaatagtcctcatttttaagatattaaagaatagctcagcggattccacatgcataaggtctatttgccgttcggcatctgtcacggcgcttttgcactgcggtcatcactaaattgattcatagagtgtagattaaattgcttctctgatttaaaacagtgtccaactttggagtatgcgtgtgagtatcttctcccgccccaaggtatttttgtcagggagaaaactgtcgccccactatccttacaccccattccgcataactgtaaaaaaataatgcatcttcgaccccaacttcttacggttcgtttcaggaactttcttaattctctccgtctcctgcccggccacagagcagagttcacaatcggatgcgtttaagtcggatttttcgtgtcatgtgcaaaaagccggtgtgtccttttcaaggtacggagccctcatcggagggcgcattagcggggtcagaggaattaggagcaatgcgcagagccccctgcagcccgcgtgctgcgccgagacctcagccgtcctcactgagcggaatggttgtgttgtttgtattgggacttttaaaaaatccagtctcaaagctaagtgctcaaaccccgttccatggctctgctgctttctggaggacatctccggtagccccaggggattgtccgtgtgaggttgggtgggtggagtagagccagaggcgcaaatgcctcctggctaaggggcagcgcgcattagagctgggtctcctgctttcggagcggagggcgtaagggagctttctagctgattttttgctagaagttttccaacgctccaaataaaagcacccgatcccctaaggacgaaataatcaaggtgttagggaagctcaacagaagagaagagacgagaagagaagagaagagaagaaggggctatcgaaaaatgacgtgttcccaaggccttagaaaaataaataaataaataaataaataaataaatagcttggactttccggggttgcagaaatccgatttcagccgggctatttaccaaaatttgtttcaaaatgactgcacctttgcttttgcaagtcacagaatgcaaatgacgataatttgttctcagaagaagtttctcttgaaatgattagcaaagtcagtcatttgaaaattagaacgaagcccttcgctaactgatatctgcttctaaagttttcattcatgtaaacctcattaatgaagatcttttatttaaacgtcaaggggatttgaaatttagagtaaattatgaagcttgtatgtctagccaagtcatgggtcaaatgcatttgtgaaaaactgctaaagagcatatggttttgaatttttctacaatgactagtgtttaaataaattgcttgtactgcttaacttcatgtgtaattttgacagaaattggcctatagccttttgatatgtaaacatttcagccttttatgcggtataaaaaagacacttgctttttaggatcagcccaggcagtcaccctgtaattcagaaagctggtacctaccattacaatcttgctagatttcaactttcaagtggcagcctcagggggagaaaaaaagaaaagaaagaaaggggatatttcaaaagcaatgtccatttgggattaaaagctacaaatgaggtgagaacgtgccacttactatctgaaagaaatggataaaccatagttattaaagaacatttctgtcagttttctttaagccagcccgtctgaggggacacttaagcagggctgggaactgactagcatgccattaaatgcttgtcttagggccgagctaatcagtccaacacacaaataggtgttaaaaatctaggtatcatttcaggatgttaccagggaaatcgctctgtgtcacagaacccattaagatgcaaaactcatccagggcacagaatggctggacacaaatggctcatatgagccatgcacgggggtttttctccgtgggaactgcaaagtccgtgcagggcacagttcagagccctccctgggctgccagggtttttgaaacacatacatacctgcataaacccatttgttgctaatatatccgtctcccgtaaataagccaaggaatgtggattggactgcgggtcaccaatggggattcaaagcgtcccataaggttgccctcccaagtgcgagaccgggccacacgttgatttcctgcgtactctggtggggcgagcgctgctccttcccatctgctctcacagtcttgccgtatttatcctatgtgtcagttttgtcatatacagactttctgagagacgccaccccttttgtgaagttttgaaggaactggggagaaagaatgctcacttgacaagggagaccagttcctttgtaaacagttgagccgcctgagcaaattgagatcctcttaattaaaaagatcattctggggcgaaatctaattaagaaaaaaagacacgctgagaaagacagaaggaggtgttttgtttacatttcttatgcattccagcttatcatattggtcagcaatctgggaaggaaatgacacatttgatgatgtaagaaaagcagaaggcttttttttttctaagcttctacacttcagtctagcctttcagtacattttgaaatgaataagggtacacttttcccccattagcagtagctttaaatttcctgaaaaaacaattgatttgctaataaaatagttctgtagcttcagctgcttaactttgggaaatgtagcccccaaaagtgcttatgatcaaaattagctggacaagatatattttggggggtaaaagaagggcacttaatacttaagagataagttgggagactgagggtttttgagtttgttttttaaggaaggaacatcacaaaatgaaactgaatgttctgggaacgctcaccatgcctgggagacagtgttacatgtctagaaagttgaatatctgtggaccgtgtaataaggagctttgtcagcatcttcatctttttcaacaagactggatgaaatggccatttgctggtacatcatctccagatctggaagtgaactttatgtcaggcagcattgttgatagtttttttttttttttttttttttttgaaacagagtttcactcttgttgcccaggctggagtgcaatgttgtgatctcagctcactgtaacctctgcctcctgggttcaagcaattctcctgcctcagcctccccagtagctgggattacaggcatacaccaccaagcctggctaattttgtatttttagtagagatggggtttcaccatgttggtcaggctggtctcgaactcctgacctcagatgatctccacccacttcagcctcccaaagtgctaggattacaggtgtgagccaccccacccagacttgttgatgctctgtaagcactgaaatgaggaaacgaacaataggtgtgtcttgtctttcaaagtagtggttttgaagtgttctgacctcctagaaggtcacttccttgggcccattaatttttgtttgccttttaaagaagcagccatactcctttgcccactgcttatgtgcagaaaccagaagcaggaggagttaggcagagaaagagaaaattggtggtagtgggggtggggggaaccactttcagaggccacaggtcatgttacctgctcagtcccaccctccatagaatctgaccctatgactcaatgatagtacagactgaccagcagcttagaagacagagcccctaccaggctgtttagataatcaggccagttcttccctgcttattcctgatgggaaagaggaggaaaattctcagaaacaacctcaactttcaatttgtttgatttgtgttgagcctttcattgtgttttcttagccgagggatcaagaatgttgtaatataccctcttccacacacactcataaacacacacacacacaccccactgcccttaaccccttcctcctttgttttgcccaattggctcagtcaataccagcttccttctcacctcctttctggagtgtgtgtgtgtgtgtgtgtgtgtgtgtttcttgtttggggtatataaccacagccagggacaaaaaatggaatgattcctgatccacgctgtggatttggtttcactcagcagtaaaattctttctgcagaccaggagttcttgggtttaaaatcacaagggtccatctcccatgtcattgggttatttgtaatttatacattaggggagaaagtagtctgttcatagtaatgatagcttggggaattcagtatatgagccaaacagaggacaactgaactaaaaaagaatgtctcttgtctatgtgatacctcacagactttttttcttaaaaaaaagcaggtccctaaagaacattttactcccttctcttggggtttgtagatatagttatttccagctctgcctggtaggtcaatacagtatttgcaagcgaaatggtgacatcaagacatgttcatgcccaactaatgataatac

SEQ ID NO: 419 - DNA, 8000 bp, Homo sapiens
  Locus number 31 genomic DNA region, Feature name CHR16P000373719, Ensembl gene ID ENSG00000198098
acacccagtccccgactcccagggctcacagcccctccaggcctctcccagggctctgcagcccaagctccctgcccaagttgcccacacataccaggctgttaggggtgctctgagccgaggtgaccacagggtgaggagggccagctacacagccccctgcctgccccacagcccctccacggacacagggctgggtggggaaggtggtaatgcaagtccctggccctgtcctgggaacctgagtgaagaccccagacccacgtcctccaaaccgggacaggcacccatgggagaccctgaccacccacaacgccacagagcacttactcctcggcaggctgggaggagtgaggggctgagccagcacaccaggcctctccactgtccacacacaggggttccatctcccaggaacccctcaccaggcctgagttctgggacaggagaatttcctttgccagtttccaacggagtaaggttttggtatttctgagggtctcactctgtcacccaggctagagtgcagtgccatgaacacggctcaccgcagcctcagcttcctatgtaactggaaccgcaggcttacattaccacacccaggttatttttttttctttctgtctttcttttttttttttgagatggagtctcgctctgttgtccaggctggagtgcaatggagcgacttcggctcaccgcaacctctgcctcccgggttcaagcgattctcctgcctcagcctcccgagtggctgggattacaggcatgcgccaccactgccggctaattttgtattcttagtagagaagggggtttctccatgttggtcaggctggtctcgaactcctgacctcaggtgatccacccgcctcagcctcccaaagtgcgggattgcaggcgtgagcttcgcgcctggccatggagcaatttaatccggggcacggtcctcggggaaaactgcctttcatctctacctgtgccaagctcagaaagcaggaggcacagcccccgaaagaaacaggagctcaaaggagcattatttcaggggcaggggaggggaggggctgggggccgggaagtcggggaacagcaccgcatcagctgccgggcacctgggcacccgcgtggctggggacgtgtgggaacttccagccggccagaaaggacacggcccctccagagtcccaggccacagaggccggggcaagtcctcaccatctcagggtggccaaggcctgacggtctccacacccacgtccctaccccgtggaagggctacgccttctccctggtccagccgcctccttggacctcagtcagggacggggaccctcagggaacagaaatgcaaagggagcccggcgagtttcccaacaagaggggagaggggcgccctttcctcagcccctcttccgccagctgggagtccctcctcccagaagccgggccggcggcaggaagcggccgtaccagggctgggggtcactgcggaagggctggagccatgacgcccacgggcccccgctacagggtctaacaactttctcccggctctgcccctctctcaggccggacccggccggtgagctcacggcccagccactcctcccagctggagtcccgggcagagtcccctgggcccctccacttccccgcgccgggcgcgccggacctgggcgctctgggaggaggagggaggggagggggcgctccaggggccgatgtggcccaaccccgatcgggggaccgaggaggaagcgcggggtcccgtccgcctcgacccctaggacacgaagcgccccaaagggccactgtgcacccccaacccgcggcggggacccccaaccccgcgccggcgccagatgagcgcacaggtgcgcccggggtgtcacaatcccgccccgcccgcagccccggccccacgcccccgatggcgcccgcgcctcccgctcaccgctcttcccgctgtagccggcggaggcaggcgggggccgggcaagcagcagcagcagcagcggccccgccaccaccgcggccaccgcctcgcccccggtcccggtgccagcccggcccatggctccgcgctcggcccggcgctacccggcccgcgtcccgcgccgccggcccccgccgccgcccgggcagcctctgccgcctccgcctctgccgcctccgcctctgcccccggcgcccatggcccggccggtccccgccgccgtcgccccgggcacttccgcccgcaggccccgccccgcaggccgagccgggaaggcgagggcggggtcggggggcgggaccggggggggcgcggacgccggggggaggggtcacgtggggcgccggtaggggggaggggtcacgtggggcgcgcgggggacggaccggggcgcgcgcggtccggggggacgctggagggagggcgcgggatggagggatcgcgggggtcccaggacggagaggtcgcgccgggcgcgctcggaacacgcaggaaattctccccgaggcgtgggctccgcggggcttccccgccggttcgctgagtcccagctccgctcggccgggacctccgtggcaggctcggggagcccgcggggggcagaggcgccgacctccgcctgggaccgagaggaacccgcgccctgccctgccccgcccggcgcgcgtgggcctgagtcaggcgcctcagcacggggacccccgggccggccttcacgccgcagagccgctgcaggtgcgtgtcagatccacgcttttatgcacagacgagaaggctgcttgtgtttagggactgtagtacccgatcggggtggcggttcacacgggtgcgtggcatcaactcccggcgctttgcacctggatggattcccaccatgtaagatttgagccgaaaaaaggaagcgataaagcctagaaaactcggggaagctttttccgtcttagggccaagtcggcttttccaagcgtggcacagagtccagaagttccgccgcgtcgtgggtgggaggggggtgggggcgtctgcaaagccaaactgcataagcgaagtccaaaagacgagcccccgactgggaggtgggggacacagcttgcagctcacaccgcagagctcaccttaataagactagtaacagtgcagtaataaacagctctaaatcaatcacagaaacgctcccctagaaaatactgaaggacagctgccagggatacgctgatcctcctccctcagcgcagaaatgcaaattaaaaactactccagctactccggaggctgaggccagagaatcgcctgaacccgggaagcggaggttgcagtgagccgagatcgcgccaccgcactccagcctgggcgacagagcgagactccgtctcaaaaaacaaaaacacaaaaacaaaaacaaaaacaaaaaacaaaacactaaagtgtccttcccaggatgtgagggtaaaaagtttaaaaaaaaaaaaaattaaaggaaaaccccattaaagtgacttctttttcctttcacctaacacattggcaaataaaaactgtactaacaggtgagactgtggcccacagacactgcttgcagcaggcagaggatgtgggagcctcgtgggaacccccccgacttgtccactgaagtaacagcagcaatgaccttccctcgggaattccacctctgcgtttttccctccaggtacgttcacggaagtggcacactgcatgcgtccagtgagtcaatgtggcaccgcctacatgcgtgtcactggccggtgggacattcaaatcattcatacggggtctaaacgagacagagcgtggccgagacaggaaagacaggaagcgctgtgctgcttggaaatggtccaccaggtgcagcagtagctgcaagaaaggaacaggaagaacggtgtgttcaaagctctaccatttgtgtagaaaagggagaaaaacacgtttcctttgtgtgtgtcaaaggcatcgaatgtctggaatgatccagcaccggctacactggttgaccttggaggaggagaggcggggtggggatggggatggccgcagggaccatacctgtttgtaccttttgaacgccgcagcgggtggtgagggtttacggagcgggggaggggaagctgactccacgagcccagacccctgaaggccagagcagcggaggtggagggtgttggccggggaggaaggaagccccggctgagccttaaagagaccctttgtttcccgggaatcccagctgggccgtcctcagccccgactgaggggaaaggggggctcccaggggttctcattttaaaggcacggaggtcagattgcagattttgctgagccgtgatttgagtgtgctgtgccggactgcacccagcaaccaaggtcagcaccagcacccaggactgctccagacccagtccctgctccaggctgggcccaagcccccctcctcccactgccctcccctgagtgagtcaccttagtctgaggttcctgtgccccaagtcacccaccggagagggagagaagcggcagagcccccacttccagtgctccagctgagggctggtgaacttgaaggtgggtaagaatccccagacggaagtccagagacgtctgctaagtcacagagtgttggcaatggagagactcttctgtaacaggaaacacagctcagtcaggctactggtcagggaaacaaaacaagccactttgtcaaaaaacagccacgcagcccttgccacaacagatgctcacactttgctggcaggcatgtgaaccccctcaaccttctgaaaattattgtgccaacattaaaatgtaatggagagggccgggcgcggtgtctcacgcctgtaatcccagtactttgggaggctgaggccggcggatcacgaggtcaggagatcgagaccatcctgggctaacatggtgaaaccccttctctactaaaaatataaaaagttagccgggcgtggtggcaggtgcctgtagtcccagctactccagaggctgaggcaggagaatggcgtgaacccaggaggtggaggttgcagtgagccaagattgcgccactgcactccagcctgggcgacagagcgagactccatctcaaaaaaaaaaaaaaagtaacggagaggccgtacgcggtggctaatgcctataatcccagcactttgggaggctaaggtgggcgggtcacctgaggtcaggagtttaagatcagcctggccaacatggcgaattatttttgtctctactaaaaatataaaaattagccaggcatggtgacatgagcctgtaatcccagctactcaggaggctgaggcaggagaatcacttgaacccgggaggtggagcttgcagtgagcagggatcaggccactgcactccagcctgggcaaccagagcaagtctccatctcaaaaaaaaaaaaaatgtaatggagaacactaaggcctagagacagacacacaaggatgtttgcagcagaactgcttgtatttggaaaaacctgggcgctccatgagggcaatgggtaaataaatcatgctataatatactctgattttttttttttttttttttttgagacggagcctcactgtcgcccaggctggagtgcagtgatgcgatctcggctcacgcaagctccacctcccgggttcacgccattctcctgcctcagcctcccgagttgctgggactacaggcgcccgctaccattcctggctaattttttttgtttttagtagagatgggatttcaccctgttagccaggatggtctcgatctcctgacctcatgatccgcccgcctcggcctcccaaaatgctgggattacaggcatgagccacagcgcccggcctactctgattttttttttttttttttttttttgagatggaatctcgctctgtcgcccaggctggagtgcagtggcgcgatcctggctcactgcaagctccgcctcccaggttcacgccattctcctgcctcagcctcccgagtagctgggactacaggcgcctgccaacacacccggctaattttttgtatttttagtagagacggggtttcaccatgttagccaggatggtctcgatttcctgacctcgtgatctgcccatctcagcctctcaaagtgctgggattacaggcgtgagccaccgcgcccggcctactctgaatatttatgcaacttttagatgggtctataaatgtgtcttcagaaggaatgtcagtaaagtgaaaaatccagttgctggataacagggacgcatcgtatttccaaacaaacaggaagaccctcaagccccctccccaggtccccctctagtgagcctgggtgagggtagactccagctgcctgcagcctggccggaggggagggttgctgggtgtgggagcagctttccacagtcggtgtgctcttcgcccagcagcaataagcattattatagttgtcttggataaaaatatcaaaagttaaataaaagcaaaaaaaaaaagccgtaatccaattttctccaaataaccaccctgtgcacctcctgcaaatgcttcctgtgtgcaagactgtgtgaggacccctctctctctgtggacactctcccaggctctgcaggttgaaaggagtttccctctgtctgttcatggccacctggtagacatgggagaccctgtcttcccactccgccccgagtttcctgagggcaggagatgggtctctctcactctgtggtcaggcaggaggagtgcagaccgtaaccctgtctttctgacccagtgccctaacctgtcagcatgaaccacaccacaggtgcccagacatcagagtttcacagacagaaatagtttccccagagttttggggcttttttaggctcaactatcatgcattattattctttcataaaaaaagggtcattttcccagcctgggcaacatggtgaaacccagtctctacaaaaaaaaaaaaaccaaaaaaaaaaaaaaaaaaaattggccttttcacaagatggcgctgaaagcaaagaaggaagctcctgcctctcctgaagccgaagccaaagcgaaggctttaaaggccaagaaggcagcgttgaaaggtgtccacagccacataaaaaagaagacccgcacgtcactcaccttccagcggcccaagacactgcgacgccggaggcggcctgaatatccttggaagagcacccccaggagaaacaagcttggccactatgctgtcatcaagtttccgctgaccacggagtcggccgtgaagaggacagaagaaaacaacacgcttttgttcactgtggatgttaaagccaacaagcaccagatcaaacaggctgtgaagaagctctatgacggtgatgtggccgaggtcaccaccctgattccgcctgatggagagaagaaggcatgtgttcgactggctcctgattacgatgcgttggatgttgccaacaaaattgggatcatctaaactgagtccagctgcctaattctaaatatatatatatatatatcttgtcaccataaaaaaaaaaattgtagccaagcatggtggcatgtgtgtctgtagtcccagctactccacagcctgaggcaggaagatcccttgagcccaggaggtcaaggctgcagtgagccaagatcgcaccactgcactccagcctgggtgactgagcgagaccccatctcaaaaataaataaattaactaattaaatcattcaagggctggggacggtggctcacacctgtaatcccaacactttgggaggcagaggcgggtggatcacaaggtcaggagttcaagaccagcctggctaatatggtgaaaactgtctctactaaaaatacaaaaaactggcacgcacctgtagtcccagctacttgggaggctgaggcaggagaatcgcttgaacccgagaggtggaggttgcagtgagccaagatcacatcactgcactccagcctgggtgacagagcaag

SEQ ID NO: 420 - DNA, 8000 bp, Homo sapiens
  Locus number 32 genomic DNA region, chemokine-like factor (C32), chemokine-like factor super family member 2
agagcaatttttaaaaaagaatatttgacttttgaagtttatactctgcttctcagttgtaagaatccttgttcacatctttgactaccttggtttatacaatcctcaggtgtaagcttcctgcaaagctgcaaaccactgtacctgcctcagtcaggcctgcccactatgggcagacctctcgctcagcctgcagaacccagctgggacttacttccaacctccaccagccctgctacatacccctgttccagcattaactaccaggcaccaaaacagtaggcattagtgcctttccaagaggcaagtcacattccacaagagggctcctcggtcgccagccccaataggaagaacatctggagtttgcagagagtttactatctgttaacattttgagggcagatatgaacctacattttgatgcactcccaccagctactagatgccaggcatgttatcagatgctttcagattcattatgccatttaatcctcagagccaatgaacctcagtcattatccccatattacaaattagcaagttggcagatgggtgataaaatacgcccaatctaggaattggcaggccaaaagagttcatcaacaaaaatactcaactgactggtactgtatcattttgaccctccagacccattccacagaaaatgccaaagatggattggatgctgcacttccagactgggagaatagctcatttcctccttatttgggtgtccctcatgggaggcaatagtgagttgagttctgattccacccattattcaatcctaggcaactgaaaaactccaagcctccaccatgtcctctgtaaactggggatgatggcaattctgactttggaggctgctttgtgagggttaaatgaggttaaatgatggactgggaaatgcttgacacatcaaagagctccattggagccactgtgattccatgataccatacactggatggcagtgcttcttgctgtgtttggacgagtgtgccagaaaggctgccattaccaaggcagaccatcaacactcaaagacttgagctattcagattagctctctggcccatattgtggttatgtcctctgggcttttgcccatagccatacactgctgccactgacacactgtgtactcgttcctccattattgttttgctaaggaaacccagccactgctcacccaggagggcactgccacgcactcatcctcactattcatttcagcacacaaagaagcaggttgggctagcagttaaagaactcaggactggccgggcgcggtggctcacgcctataatcccagcactttgggaggccgaggcgggtggatcacttgaggtcaggagttcatgaccatcctggccaacatgaagaaaccctgtctctactaaaaaatacaaaaattagctgggtgtggtggcaggcacctgtaatcccacctactcaggaggttgaggcaggagaattgcttgaacctgggaggcggaggttgcaatgagccaagatcgcaccattgcactctagcctgggtgacaagagcgaaactctgtctcaaaaaaaaaaaagaactcaggactgaaatccaattgaaacccagaagaaggagcacaatgagcctgcagatgtcggggcacacccaattctggccatgtttcaggaaagagcaaaaaacattcactccagaatatcaggcctgctcctcagatgagttcatatgctcttgggacacatgaactcacagaataaatgtggcccaatttccagagcgttggctttacctgcagatttgggagaagaagtaaaccaataattaaagtgctcatctaaaattttatttttatattaaaacaaatgagttatggaatagaatgcagaatttacattaaaaaatataagacttcccaaaaaaaatcacatttatggagggccaatttgggataggccccttgaccaccaggttttttcatgctcactttcctattccctttaaggaaaaagttgttagctttttttctaatggtattctttaatgaaaataaacccgtttctacagacaaagtcatatctaggatcttaaaaccacataaactcatgtctctggacgatgtaagaattatgcctctgaaggttcctcctcatcttaatcaaatggaaggttttttaaaggcatctattcttagatgtgtaattgaccagtttaaatatttgtgaaattatattgttgtgtaaacttgataattttcaattctttattacaggatcttaccaacagtatcattacagctgtgttcctttcagtagttgccatcttggccatgcaagaaaagaaaagaaggcatttactctatgtcgggggggtaagtagaggccttcatgactccatttaagatcagtattccaagactttgaaaagggaaattggcagaccccattatatcattaaccaagcaaaatccccactgccacccactctccttcttgcactgacttcttcaggtgatatgaagttgcacaaactctgagctcatgaaaatcttaattctaacatgcattctccaaataggtacaaaaacaagagtctgctaaaccccttttgagaattgtggacactatttttgaaatgttaagcaagatctttttgtctataaataggactttgattttctggactagagaattgtattttaaagacagatgataagagagattgtaaggggggaaaagtgcactgtctaaagtgaggaatccagcctattcaggaaggaaggaaggaaagaaggaagaaaggaaggaaggaaactgccacatgttgaagtgcccagtatatgccctgcaccaagcagggcacactctgacttaatctttacaactctcatttgtacagatataggaactgaggttaaataccttgctctgggccacaagactgggacaaattgggactcaaaagaaatggcagatcaaatgcttggaagattcagggggttgggaggggaggtagggctttggttcaagaagttaaacaatgagaacagaaattaatgcagaaaaagagttcatttgaattcattctataatcaataaatatctgtcaatcccattgattgtgccagacatgagctcagtgctggggatagagccctttcccctttggggaagctcacagattcactggggcaagacatacctaggaaaagctcattaagcagccaggaattaagtgaccataaagagaaacatccaaggttgtcaagagtcccggagtgcacaggggaatatctgtgccatcagcccctggtccccatcggctgactccgctatcactccttctactgccaggggttcccacccccaggtatccatttcttacctggatggcagcatcccaccccaccacgcactggtcttcctgcctccagcctggttcaccttccattcacctcatgaacactgcaagcaggttttctgaatctcacacctgacctcctgatagagtcccagatcctgcacctctccagcctcaactctgcccccttctcagcggctctggaggtcctggccacaccagattccttagagaccctagtccagtgcctgggtcctcctcctccccttaggaactccttcctgccctttgcaaacatagcccaaaagtctttccacggagagggcttctcaggacctaacccctacctgcagccacctagggccactgcccttccctagtcctttccgggtgcctcagacatcaagcgaggctactactggcaacaaaatcccccacttccaaaatccctttttctgggaaaggcagaatccgcctgcagcagccaattgggcaggcgccaagaaagtagtgaagggtcagaggggacaggaggccacccgcagcgcccaccctggatagggataggttcgagaggttgctactgagctgcaaaataaccccgtctttccttcccgcatatggtcttgtatctgacagtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaacacctgcttcctctcgttgccttgtgtgaaagtcgcgttgtattttcctgcgcttggcgctgcgcccgcggagctcagggccgtgacccggtgctcgcagccccccgaccccgcagcggagcggcggcttacagacctggggccacctggagacgccgggatgggaccgcgagggcagctccgcgcggaggtgggaccggcgggttgggaacggagttggggcccgtcgggggccggcgcgtggagggtgggaggatccggccgctgccgggcggatgggagctgcgcgaggagacgggcgcgcgtggagagggcgcgggagttggcattcggtggtcctggcagttagctgagcacgccctctgagccgctcggtggacaccaggcactctagtaggcctggcctacccagaaacagcaggagagagaagaaacaggccagctgtgagaagccaaggacaccgagtcagtcatggcacctaaggcggcaaagggggccaagccagagccagcaccagctccacctccacccggggccaaacccgaggaagacaagaaggacggtaaggagccatcggacaaacctcaaaaggcggtgcaggaccataaggagccatcggacaaacctcaaaaggcggtgcagcccaagcacgaagtgggcacgaggagggggtgtcgccgctaccggtgggaattaaaagacagcaataaagagttctggctcttggggcacgctgagatcaagattcggagtttggtgagctaaactggtatccctgggtggggggccttggccgagggtggggggaaggaggagtaggctccaggggtcctcagagagatggtgaaaggcccttgctgctggctcaggtgtctatgtctcactgcagggctgcctaatagctgcaatgatactgttgtcctcactcaccgtgcaccccatcttgaggcttatcatcaccatggagatatccttcttcagcttcttcatcttactgtacagctttgccattcatagatacatacccttcatcctgtggcccatttctgtaagtaaggggtgatggggagtgcctgcatccagaatgctgatcaggtgtgtcttggcacctggaaagtcaccaaacagagagacacacctcacctcccatatctgtgcctgggtcagggactcagaacatcagtggggcccaggcagaggcagctgggtgcaagaggggtagctaggcagaaaatgctccaaaaagcctatctgtgtgttggagtgagagtggggaactcttacttacctggtggtcaaagagggcctgagcctttgttctctttaggggaaggggaggtgtagcaaccagctgttcctccgaactcctgtgccagctcacacttgacaggagatcaccccagaaggaccccattcccaaaattcaaagaagaaaattactctcccataagtcaataaaataaaacaaaatgggaattttttttaaaaatcacttctaaagcagcgttaggtctccagtgaatatccctataaaggatgtttggatcagaaggatgttcagcccaaagcagtcatctagtggaaagagacagaactgggcaagttactaaaccattcccagcctgtttcctcatctgtaacatgagacagtcacattccttgcagaactgacattcaatcctgaggattaaatgtaaattgcttgacaccgtgcctgaggactcatggaattgaatccctgcccatcacctgtttaaccacagggcacaaccacctaaccccttgccagtcaatgaagaccccaattcccaagtccctttgttcattgcacattcacagcctgcctccagagccctcttgttcactgtttcactcacgttacacatgaggaaattggcctagaatggccaagtaacttgcccccaggtcactcagctggtaagtagcagaaaaaagcttcaaacttagctttatgagtacatttcatcctgccttcttgttaaaaactattagggtccagggatccagaggtcttggtgaagcagatgaggacctccgatacagggagaaaggacaggagggccaaataaggactctcagaaaagggacaagcagaggacaaggtaaaaggacaggcagaggacaagttcctaaacaaggagcctgagaagacatttttagttccagcaagatgaaaaaccaatgaaccctgaacatcttcccactgtgcttacctaaaaataccaggggaaatgtaaccagtattgctttaactgaatgaatgagctggcaaaaaagaaatgaaaacacacaggcgccagaaatggcaaacagggcagtgatcacataagctacaaagtatgagtgggaatggtccaagaggtattgtctcaggaacctacagcctggattttcatgcactctcaagtcaggaaataaggccttgatcctaagcaaagtgggaatttagaactgaaaaccctgtataaagccagcgccctggaaagactacctccttagggaaaagatggacaaagacacatacccttcttattcccaacacagaggaataagaaaacatgttcatctctgcctgagctttgagtgggcggagaggaagtcttccttgagaaatagaaagcttaagcctgccctttgtacagattggagtttgaatttttgttatctgcagcctagaaaccttcatgcagcccagaaaccttcatccctgggaattaccataaaaactgatcccagtctgatgacattctgctgatatccttggactcctgatagaaacaaatgcaaaatcacaatcaaggcatgaagagattctcacagtgggggtggggggaaaaccttgtcaaaaatgaactaataattcaaaactactaaacacctgattttaaaaaatccccattactaagaatcaacaaacacaacaaatggattagaatcctgagaatatgagataatagaagagctgtctgaaaataataatatattttaagggattatagacataagagtcctgagaaaagagtaagacactatgaggacaaaatagacagatttttaaaaagtacagtgtctagaatagaaaatatagttattgaaataaaaatgtcaatagatgaattcaaaaacagatcagacatagctgaaggagggaactgttaactgaaaggtatggggaaattacccagaacacagcacacagagagagagaaaataagagattgagacagaacaatgagtgagaacatccatcagtggttgttgggctgggtgtggtggctcacacctgtaatcccagcacgttgggaggctgaggtggatgggtccctttggtccaggagtttgagaccagactggacaacatagggagaccctgtctctacaaaaaaatttaaaaattagccaagcatggtggcacatgcctgttgttccagctactcaggaggctgaggtgggaggatggcttgaacccaggaggtcaaggctacagagagctctgatggtgccactgcactccaatctgagtgacagagtgagaccctgtctaaaaaataataaaagaggtgtcaagaagccaggcacagtgatgtgtgcctgtagtcccagcttctcaggaggctgaggcaggagaatggcatgaacccgggaggcagagcttgcagtgagccgagatcgt

SEQ ID NO: 421 - DNA, 8000 bp, Homo sapiens
  Locus number 33 genomic DNA region, cadherin-13 precursor, truncated-cadherin, heart-cadherin (H-cadherin), P105
aaggaaaaaaaaaggcaaggagagaaattcagaaggattgcagctctgcccacaccttgattttagcccactgagacccactttggactcctgtcctgaagtgtaagagaataaagtcacatggttaagtcactaaggacatggcagtttgttacagcagcaataggaaatggatgtaaccttttttatatggtttgtgggcttgaaagagatgacgtgttaaatacagtagcttttgaccttgaaagagacgatgtgtgaaatacattagttttgggggcttgaaagagatgacaggtgaagtacattaactcttgggcatgaaatacattagcttcatggccgttagcattggccatgaagagctcttgaccaatagtagctggtgttaccaataataaaataatggtgagacttgagatgacacaggagtgttctaacagaggcacagtccacttgaccagatctttctcaggcatctccatcgacagtggggtctccctagaaggctgggtggctgccatcccacccaaccagcctgcctgagttggtaaaagtgcatgaaagtgttcctctcagggggtggccttccattggccctcacaagggcacagcggagctcgttggttatgcttcagttacataaatccagccttacaaaggctacacagagagaggggctccttgcctcctagatctgtaccttgtaggtgctcaatacacattggtaagaatgttcacatcatcaggtaagcaaggggtataaagtgaggccttgaatcgctcacgtagattcaagtagtgttgagaaactaagaagtggtgaattgtacccttttttcccctcccaaattagaactcctaagaaatacaggacaactggagaccaaaccgtaggtttcattacctatgaagctgattaggaaagccttgagtttgtacccaaataaatttgctaatacttttacctaaattagagagattcggatggggtgggataacaacacgccacatctacctgggtggagcccatctcaggatgcctctgcccaggaggaggggcagtgagaaggaggccggaaggggaagagaaacaggagagggaaaggaggaaaggagacatagctagggagatgccactcagcaatcagaaacctccattccttttcctggggtggagtggaggaaaagggaaggggcagggaggctcctagcccacaagccacttttgtgcaataggaaaagatgcttgaccagtgacgatgagcttttttccaaatgttttttggccacagaagtgtcttgagaagtttctgttcatatccttcgcctgctttttaatggggttgtttgttttttttcttgtaaatttgtttaagttccttgtaaattctagatataagacctttgccagatgggtagattgcaaaaattttctcccattctataggttgcctgttcattctgatgatagtttcttttgctgtgcagaagctctttagtttaattagatccccatagtcaattttggcttttgttgcaattgcttttggtgttttagttggggggtggggggcaagggaagggacagcattaggacagatgcccaatgcatgtggggcttaaaacctaaaatatgggttgatgggtgcagcaaaccaccatggcacatgtatacctatgtaacaaacctgcacagtctgcatatgtatcccagaagttaaggtaaaatttaaaaaaaggaaataaaagatgcccgttcctctgaatggacatagcccatgccaagggtaaggcttggtgagtggaacaggctggattttaatcctcaggttgctgcacccttggtgaagcacagggcactagagaagagtgttcacaacctccagcccctccacaaagaagcctgattctggaaagacagaggttccaacctcacccttacttctcttctgaagatctgctgtgcatgaagcattttggaggtatttcttcagctcagaacacagcaactttcctatgaaagagagcacaaagggttaatgccaccagaagacactcagcctgtccagtgtcgctaccactgggacgggcaatgggaggcatctgaggctttgctgacaacttcttctgctgtgagggtggaaagcaggccagatctttatgacctggactccacgttttgggattctagcaagatgggacccactccgggtgctgtgcccattctcagtgccagtggggctgatatggggtcatggcaggtagcgggagataacagcctcatcctcaacactagacatccagacagagtggctcaggccctgtaagcaactggtgttagggcagataatgagattttctggtgtctgcttggtgacaagagtagtggcttcaaggaatttttttaaaaaataacatttgtttatagttgtgttttttaaagtagaaaatatattcatacgagcaagtaattagtgtcctgccaggtaagtctcatggtgacatgtcaacgtaattattttttaaagtctgcctcaaataaagcatcaaaatttcctgctttaaatctcctttctctgtaaaaatggttaagaggagtgaaaagagaggatgggaggggtctgagagcattgatgcctcatcatagtcagccagctgtggcaccacctctgtctttgcctgtcactctcatacaaaggatgtgcataggaaatgtgatcctacccatcctcaaattctagatttggacttgaatttggtgctcttatttccacattaagttaaaatctagcctccagatccccaggcttcccctcccattgtacccagaagaaacaagaattgtttctcagttctaactgtcataatgcctagcgggcgttagcctacaacgaaggataattcaatctatcctcaccttagtgtacgctggacaacactaggactcagaagtgctttgctcttgatcttgaaaggccagtggaaatccatgcagattcctcccccaggaccctcccagccagcctgataatgaattcatgggaaacagcctacatgtgagcaccaaagggaacacatttagtaaactctgccaaaggagcacagttcttgtaaagctgatgaggtttgtgattaatccttttttttttttttttttttttttttttgagaaggagtttttgctcttgttgcccaggctggagtgcaatggtggaatctcggctcgccacaatctccacctcccaggttcaagcgattctcctgcctcagcctccggagtagctgggattacaggcatgcgcctccacgcccggctaattttttatttttagtagagacggtgtttctccatgttggttaggctggtcttgaactcctgacctcaggtgatccacctgccttggcctcccaaaatgcctaacccagtttaaagagatccaggaagcagattgtgagctgcagatatgatgtgattattaaaagcagcctccattgccaacattgcaaacgcatcagcatgttccttccttcaacattccataacgtggtggtggtattcccaccttaccccgggagaagctgagagtcacagggagtatttactttccaagttcacacattcagggaatgggtagaagtggaattcacacccaggtcagtgtaagaccaaagaggctgtcagaatggtttgctgttccactcatggcaaacaggatttgaagttgttccagtccaagggagaccatcaggccatgcaggaataaaaaggccaaggggaggaaagaagatgctgtcttcattaaggcctgaaggaaaaggctggtcagagtgaagagtatagacaagctcctctgtatcctctcaaagatttggagccactgatctctctgggggttggggaatggggcagttcctgggaaagggacttattggtgggaatccagttctgctatgaatgctcctgactcctgcactcaaatcccaacagatgaaagggaggagagactgacagatgcagtgccttcctttatgtaacctccttgatccaaactacagtctgacccatgctttctggctttatattgtaccactacgttcctaactcaccctcgttccaatggcatcagcattttctcttccctcaaagataatgcacttctgacttttgcatattatggtagccagcccccaggagggctcccagtgattctcacctcatggtacccatgctcctgcgtggtcccctcccacatcgaataggaatgacttgtgtagccaaataggacatggcagaaatgactttgtgtgaattctgagccttgtttattcttgtcctttcttgctacaggcaaagccaaatgccgtgttgtagggaagctcaagtagcttcatggagaaatccacatggcaaggaactgaggccacctactaatagccagcatcaattctttagccgtatgtgtgagccaccttggaagtagaccttctagcccccatcaagcttttagataactgtagcctcaccaacatcctgactgaactacacagctgagcagcttccatatctccaagccacaaacactgtgtgcaatcataaatgtttttagttgctttaaagcactaagtttggggtaattttattcagcattagataactaatacacatagtctgtttcaccagctaaaattgctgctcatttctctgttaccccccaaacctggtgtgagcagcccctcctctgtggactttttctggtcttctttgcatgactcaatccctctttcttcattttctcacacagattgtttagcattctattaatgccactgtcacaaggaaaagcaatatttttattacagtctctctcctctgtcgattctaggcttcttgagaaagtttgtaatgtatgcattcttcaaagaggtattgttattaatagaggctcagaagatggctgaatgaatgaagagtgtgtgttagaacctggggaaatttaaaccaaatacatttaaagccagtgacattttcaaagcatatttggctagaaagactaagttctttaaagtagtttagaagcagtattaatggtacacagtctttgtcccattcttaacagtacaataatgataattggttgctactctggaaacaaattaaagagcccaggaaacgtttccaaaggtgactggaatgcttaactgagctagactgttaatatctaatgctagccttcctgtgggcatagcaccctgaattgcctgatctcatctaatggcacatgctcagacatccttggttttaaataaaaattgtcttatcacttagtttaaaaatgttttgcttagtaaaaaatttatgagggcaggtgcggtggctcatgcttgtaatcccagcactctggaaggccgaggcaggcagatcatgggctcaggagttcgatgccagcctggccaacatagtaaaacccgtctctactaaagatacaaaaattagcagtccgtggtggcgggcgcctgtaattccagctactcaggaggctgaagcaggagagtcgcttgaaaccgggaggcagagggtgcagtgagccgagatcgcgccactgcactccagcttgggcaacaagagcaacattcggtcgaaagaaagaaagagagaaagagaagaaggaaggaaggaaggaaggaaggaaggaaggaaggaaggaaagaaggaaggaaaaggaaggaagggaggaaggaaagggaaggggaggggaggggaggcgaggggaggggaggagaggggaggaaagggaagggaagggaatacatttaataaatgtggagtctgccaaatcaggtcggcagtttacttctcctgtccccggttcaataactcacttactggggttctggaggatagcagtgagaagatggggtaaaaaattagagagaagttttgcgttgccccatggctgcttctgtagtgtagtccgtgcatccgcccttcgatgcttgggttggatcatagagcagtgactgttgatggctcacccagatccccaggaacccaccactcccatacaggctttcaacctgttaatccctgcagctgcctgcctggactttcctctgaccatgggagtgtgctcagtcttactgcccagggaacagccatcagcctttgagtggcaagagttggtagattaccatcccttcttgacccttggaataggacaacttcgagatatgttctcccgagtctcccagatgaccccagtgagtttgaacaccagttgtccacagagataatctgcccattgccacctgtgtattgactcttttacatattctgtctcacttctctttctccctcacttgtgcttcttaagattgtatcctgaataagctatttgcactcaaataggcagagagctagctggatccattattctctcttgtcttctatattttagatatcttgtaacaggcacaaggtaccgtgtagagctgaggtgtaatgacccagctgatctgtttgtactttctcatgctgctaatgggtacctggagttgagaatttatgcataggtgtgtacatgccatcacagctctgtgtgcatgagtgcctgtggggtctgcatagcatgcacacatcacagaaaccctctgccctcccttctcattcctctatttgaagccaagtttccataatccctctactcaacccccttcttccccagcccccaggggcttcccatacttagggtcaccctttcttacctcagagtttcaaagatgtaagagctgatgcccaccttgatggtattcacaaagtatagcagggaggcggccatggaaatgactctttacagcaggatgatatgtggaacatgccatggccagggaagtaactttgtctcaaggggatcaggaagatgcccaggtatgggataacttgagcaaaagatttttgagcactgatctgcagattttactctctgtaaagggccagatagtaagtattttaggctttgtgggccatatggtggctgctgcaactgtgcagctttacttttttgtagcacaaaagcaagcatagataccacataaatgaatgagcatggctgtgttccaataaaactttatttacaaaagcagatggtgggccagatttgtcccattagctgtggtttgctgacctctgatttaaagagtgggaagtagatttctggaaagggagaaaggaagactatttctagcagagagaagaaaacatataaaggcaaagagtgggaaaccagagggaataagacaaatttgatttaccaaaaagtcctttttggtggtagtaaaaaatactaataataaaaactaagttttattaaagccttattatgagtcaagcattgggctaaatattttgtggattctcatttaattattactctctctgagtttggaggaccttgttttcctcatggcacacacgaggagtaaattaagctcagagagggtagatgactggctcaaggtcacacagctaccagctggccaggtggcaagaccccggacagaggattgggagcatggtattgtagccagcgtacctccttgtgtctatcattagccctgctttaatggactttttcagaagtgtttttgcttgtgttttacaagtggaatgtgattccttgactcagcccagtagccctgtgaatggatggctgaaacgagtctgacggctttttctcctggggccattttgtaagaaataaaagcaaaacagtgagatatttaaattcttcagggatattattttcgagtggataaagtgaagaacattttttattcatattagaagtgatagttggatgtgtgtaatttttttgctctccgagatggagagagaacacagcacagatcttagaatgtaaaatatgaatttagatgacattttgagaaaactgataaacaccaccattccacaattggacttaacttgcctgtgaaaatcc

SEQ ID NO: 422 - DNA, 8000 bp, Homo sapiens
  Locus number 34 genomic DNA region, laminin alpha-3 chain precursor, epiligrin 170 kDa subunit (E170), nicein alpha subunit
atgtataaagatgcaatttatatgatagtaacataccagagaagaggagggaatgatactaatagaaacaaagtttttgtatactgttgaaattaagctggcatttatataaatcgtccagcatggacacatgcatagagacagaatgtagattagtggttgcctgggtttgagggtggtaatgggtagtgactacaaattgacacaagggttcttcttaaggtaatagaaatgttctaaaattacattatgatgatgtttgcatgcttccgtaaatttattacaaattgtatgcttaaaatgagggaatattattgtatgtaaattattccttaagctgctaaaatataaattaaaattatataagcatcatatttgtatgttagtaatagctaccatttgttaagaatggtgctgaacactttatatatattgtatcatttaatttaccttaattataatgatagcacaagacattaggtattactgtgcctatttaagagatgtaaaaactgagttcaacaagggcaacaaaatataaaggttaaaaaggcaggcttttggaggccaggcgcaatggctcacgcctgtaattccagcactttgggaggctgaggtgggtggatcacgaggtcaggagattgagaccatcctggctaacaccatgaaaccctgtctctactaaaaatacaaaaaattagccaggcgtggtggcacacacctgcagtcaggagtttgagaccagcctggctaacatggcaaaacctcgtctctaccaaaaatacattaaaaaaaaaattaggtcaggtgcagtggctcacacctgtaattgcagcactctgggaggctgaggtgggcagatcatgaggtcaggagttcgagaccagcctggccaacatggcgaaaccctgtctctactaaaaatacaaaaattagccaggtgtagtggcacgtgcctataatcccagttacttgggaggctgaggcaggagaatcacttgaacccgggaggcagaggttgtagtgagctgagatcacaccactgcactccagcctgggtgacagagcaagactttgtctcaaaaaaaaaacaaaaattaccaaacagaacatagcaagtgttgacaagagtgtggtgaaattgggacccttcagccctcttggtgggaatgtgaaatggtgcatccactgtggaaacactgtggaaatatctcagaaaattaaaagtaggattaccatatgctccagcagtcccacttctggatatctatctaaaataactgaaaacagaatcttcacaagatatttgcacattcatgttcattgcagcattattcacaatagccaagaagcaaccaaatgtccatcaacagatgaatagacaaagaaaatgtggtatatatagatatatgcaatggaatattattcccccttaaaaatgaaggaaattctgtcataggctataatatagatgaaccttgagaaccttatgctaagtgaaacaagccagtcacaaaaggacgaatacttcatgattccacttatatgaattatctgaaatagtcaattcttagcaacagaaattagaatagtggtgccaggggctggggagggaaaaagggaattgttcaatgggtatggagtttcccttttgcaagctggtaagttctagagatctgttgtgcaatgttgtgcttatagttaacaagactgtacagttaaaaatggttaagatggtaaatttcatgttgtgtgttttttaccacaataacaattaaaataaaataatataaacgtttgtgcaagaaaagattgtattttctgtcaccgatgtgtacgtttaatgaatgacctgagctgcatgactcagtcagtttccatatgccttccttccctctttctcactcaccttatgtttgcacaaacaaaagcacatttaaaagataagttggacactgggaattttatttcattttattgccccttattccctgccttcattttttttccttccttcatgggaataacccaggacacctgacttctaaatgtaaatactccaggaggcaggtatttccccgtcttatttcatttctccctatgcattttaagtgtcttgtttttgattcattcggggtgtctgcctctaaggaacccctggaagtgagcctgcctaaggaagaccctgactttctgtttccatgtgtagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcaggtaggaagttttcccatccgcaacatttccctagggagctcctgtggccgtttttggctgctgtccagcactgtgggatggtttggggccctctgtctattgtttctctgttcaagtttctgcagggcttatcttatatcttacttagactcccttcaggaattaagtgtgaaaaagacatcatcagtgtctcagaattcataggaaagccacagagattcaatagatgctgagggttagagaaatccagggtaggaaaataatgtactatagtttcaaatagctagaaggaggatattgactattcccaacacaaagaaatgatcaatgtttgagatgatggatatgttattaccttatctgatcactaaacgttgtatgtgtcacaacatcactatggactccataagtatttatcattattatttatcagtttttaaaataacatattttttaaatgaaggagctcaccagccagcatcttagtatttgagcccctgctttcccaataactgaccttatacctttctctaatccggagcctccctctacccactctcaactccccagtagagttgaattccagagaatatcctggatttcttagaggacattatgttctagcttgcagcaggactctcgttgtttgaggtccagtcaaccagagctgtcttcagatgattaaaatgtgccataaaatgaaactgtttaatttctctggctataagtatgtcttttcttaaagatcagggcaaaagcacaacgttagcatgattaataaaagtagcaaacactcattctgtgtattccatacatccataagtacgtaggcttagcaaaacctttcactttctttcctggccccctggtagccgaaaaccccaaggtgatctgcgcatacgagttcccactttttaaacctgcaaaaacaaatctgacctgctgtggtcttctggggactccaaagttgtaatatttagcccacaggttgcctacattcttccccttcctccatctcttttctagcctgattaaaattgatagcccgagggaaagagagggactctggatttccaccctcctacccagggcgtgttccctgcccgtgactcagcctgtgatttagggcgtctgcagggtgaggtgggtggaaggtgatgcccgccccacctcacaggaattacagagcggtgcgcttacctgcgggactgttatgtgcgctctggcacaggctgactcatgtgtgaagtttaaaggtggggcccctgccgcagacagccttcctcacctgagtcaggcaggcccgggcactgagcaggaagggcaggtataagaggaagaggcagaggttcctgcgcagccagcggacgtccaggaaccgggatgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccaggtaacgtccttttaagttttggtttgtgatagggaagagtttccagctttgtgacattttaagttacagttacggtgattaatgagtaaatgggtggactgaggaggggctgatggcctcccagtcaccttgactggcagtgtttattacagtgcctgacagattgctctcccgagctattaaccgcaaaccccattaacatcagcccacctggaaatgccgagacagttaagagcttgaatgcttgcgggatgttaatatacgatgaaactttatgccctttagagaccatcccaagcctcagaacaaaagagtccaatgcctatagctttccaaatgctacttggaagaaaatttacccacgggggggagaaaatgggaaagagtgaaatccaatgcttgagaaaagtgatcaaagtttgcataatacctaaaagacatgcttccatttgccaggcatgaaacattaagaaattctgctctctttaaacttcctggatgctgcatgtattcttacagagaaatagatcctatggctacagatacagccctggaaactggattagggacataatattatcatttgtatataatatgtattacaaaagtttactggaaaacttaacataaaacatcatcatgttaactagttataaaacccctgtattgaaatagtgcattagaacacattcgttttcatttaaaagtgagtgttcaatataatctgagtacttgaactgatttttttgtagaatgtggttttgcttgctttataagaggtgaaaaaatgattctattttagtaactgacaaatcctcagagtcacatgatatgtaactcttgcagagtatattttctgcttgtaatcaaaagcaaattaagatgggtgatttagttttaatcaggacagactatactcccccaaagcatgtttaattaaggcttttttctcaggcatgttgtcataaactaaccagatctatctgcttatttgaataacttgctctttaccaaatgtgattattttgtaagcaggtaatgtgatatacactgataattataagttacttgccacttattaggacagattgtataatagatagaatgacaccatcattggctgcatttcgttcacatgtaaatctcaattgtgctttcagcaaaataacattcctttcatactttgattctcctttaggcaagcctgttcatataacaacataatctatttatttgcaatatactctttgccctaaacatggttcctaatagcttaaaggaacattatattggaaactgtggtcttattgtgcatgatctatattcattggtaattttggaaggggttctagcaacacctgggagattccactcccggagcacatgaggcttctgcctctctctcctgtcaggtggcttctttctcacttccactggaccaggtagagacctttatggccatgagtgaataagaatggactgtctacttcaagatttcctttgagtatagtttccaagttttacagacatatgtgctatttaaagaagatttgataaaagactatcctttatcttgaaatagttttcctgatgctttcaagatagggtatataggagatcagagaaataaattagggacaatatctgattttgtttatttattattagacagggtttcactcttgttgtccaggctggagtgtggtggcgcagtcgtggctcactgcaacctccacctcccaggttcaagcgatcctcccacctcaacctcccgagtagctgggactataggcatgtgccaccatgcccggctaattgttgtattttttggtagagatgaggtttcaccatgttgcccaggctgatctcgaactcctgggctcaagtgatccacccgcctcggcctcccaaagtgctggaattataggcttgagccaccacaaccagccaatatgtgatttgaatctgtgcactgatttgctctgccaaaataaaggacatgtctataatttcctttaaagacagaaatctaaataattttaatggctggtataagaagaattgttttttttctgttggagggattcttaactagaatccttttaaaaagatattagttcatgaaaagaaaattataattcttttcatccagatgaaaatgcataacttgtattatactggagagagataatatacaggagatagaaataatcaaatcaagattgaacaaggaaacaagaccaacccaaggagagtccctcaggctgagcctctgtgtgttcgggtggaccagatgttcgtgaacagtcctgtatgggaacctcatgcacgctcccctcccctggcttctctgttgcccatggcctagtgagtggcaataaagtgactccactgattgtggcatgattgtctaaatctcagttaagactcctattccccacaacccactactcctactatactgccccctcaccagcccaaacccacacttggagagaaaacggctagccaaagataatttggacttgaagtgatttgcttagatgtcctcccctctaaggacgagtctctttatttgtccatttccaccttctccacctgccctcaaaacagttgtgagaagagaggagccccttctcatcccccatctccacacgtgccctgtctctgatttccccaccatgcatctcacactcccaccagggcatgaaaaccaaacagcttgagagaaaaacaagtggacatgacaggtggttgaaattaaaaatattcacactcactgaaggaaagaaggtttgaaaaatgtatgcctcagccgggctcagtggtgcacatgcctgtggttccagctacgttggaggctgaggcaggaggattgcttgagcctaggagcccaagactctagtggactataagcacacctgtgaatagtcactacactccagcctgggcagcagagtgagaccctgtctaaaaaataaaaatgatgtgaatgcttcacagtgagaggtgtcacatgctttggatagtaattgttttctttctttgtattgattaaacactttgtttgaaaaatagggttgtagccctggatactatcgggatcataaaggcttgtataccggacggtgtgttccctgcaattgcaacggacattcaaatcaatgccaggatggctcaggcatatgtgttgtgagtaaattgacactttaatgctatcagcagacaatctgtttctcctccattcccctgtactatgcccaaagacatcaacattacatctcccgccaaaccctaaatagaggtcgctgtgtaaatatatgaggctccattatcaggctgaattattttacatttcattttctcctccattttaacatgcaccattaaaagagcgctgctgtctgagcaattaagttacactttagcttctaaatctctccttcgtgaaatgatagtaatgggtggaccttggaagttaactcttgccaggacaaaactaatccaagccactactttgggtcccaattttgttggggcggcaggaagttacaggagtggggcttgttgctgtcagatgtccagtaactcaagaaagcagccagggagaaggggatttgaggagggctcaaggctcataagaaatcagtccaacattagctgggcatggtggcaggtgcctgtaatcccagctactcaggagactgaggcaggagaattgcttgaaccctggaggcagaggttgcactgagccgagatcgtgccactgcactgcagcctgggcaacaagaacaaaactcggtctgcattccatccacccccacaccataaacaacaacaacaacaacaaacagaaatcagtccaacacaagcttcactactgccaagacagagcggggcttggagaagacagatgagggaggtcgtggggaagggaaagtgctgctcacccctcccgtcctcacaacatccaccgcctgcctgttccctatattgactatatttt

SEQ ID NO: 423 - DNA, 8000 bp, Homo sapiens
  Locus number 35 genomic DNA region, Feature name CHR19P018622408, Ensembl gene ID ENSG00000167487
gggaggaaacgagtggggagaggtcacatgtacctcatcagtgttactgtggcagtgctgacgcccatgatggggacactgccatccttctgcccgccatgcccgcatgggccttgaggggatcgtcaatgccagcaagccttgatgtggcgtgcgtgtgtcaggcagggaaaggagagggtgaacttgagccattgggaagacagtagtgccatgacttgggccgtaagagggacagcagcaggggcagcgagagagtagagcacgtccagcgtgagctggagagggcaggttccgccaggagtaggcctgggagcaggagctcggcagggcgggggcaggggcggcggggggtggcgcgtctcagcagggatgggggcaggtggaactgggccagcccaagaagggcactggcccacaggccgagccacatccaggccactcgatctgcccctcacagctgagccccttctctgggaaggaggccaccctctcctcccctccttgtcggcaggtcccaagagctctgggagtggaattgctctgaaagcactcacttcaacctgaatcgtgcagtgcgatcgtcacagctggactgtttccacctggtagctgtgacccccgggacggcctccttgtcgttgtccgtagttaccggggaagaaaggctttattaccctccgccataatcgcaccatctccagggagcccctgcgaatgtcatcccacctcccccacggcgattactttttatctcacccacctctcctcagacactgtaaaagggaggctttctcctcactccagccctttggttttttcctttttctgatatttgtgtgtgtgtgtgtgtcttaccctttggttttagggaatgttttagatttggtgttaagaggccctggaggaggaagagaggaggaggaggaagagtggaggaagaggaggaggagatgagagggaggaggaggaagaggaggaggagaaaaagaggaggaagaggaggaggaagagaggaggaggaggaaagagagaggaggagaaaaagaacaggagaatggggagggagagaggaggatgagggggaaggacacagatagaaataattcagcgacttggggccttggatcctggaagaagggggtgggatctactgaaggcaaggggtgactgggcagcatgtgtcccggcatccccagctctttgctctgtggacaggatttgttagacacatttctctgcctttgtgcaggtgccacagtctcctgtgtccaccccatgcctggtgctggacatgaagggtccatgggacagatggaccctgcccatggggcgcatacatgccagcaggagttagagaacgtcgtgcggtcatttccgggctggctgggccagggggccagggcagggtttgggtgagcggcatatcagtcagcctcctgttttgaaaggatccctctgtaggccgggtgtggtggctcacacctgtattcccagcacattgggaggccaaggcgggtagatcacttgaggtcaggagttcgagaccagcctgggcaacatagtgagatccagtctctactaaaaatacacaaaactagctgggcgcagtggcgggtgcttgtagtcccagctgctctggaggctgaggcacgagagtcgattgaacccaggagccgagattgcaccactgcactccagcctgggcgacaaagtgagactctgtctcaaaaaagaaaggatccctctggcaagagacaagggaccctcggccaaggtgggccctggagggatggagaggcacacgcaggcttggggatgcctggaggttgagcttgtgctgactgatagtggtggccagtttctgccctccccaccgggcaggctgaaggtcagggttgtccttggtcccgcgcggctgcactgcctgcaacaagcagcagacttggaggcgccacctggcctaggggattcgcagcccttcctgtgttccagaaaagcccttcatgcctctccttgctcagggttcgtgccacttggagctcccacagtccttgagggcttcaggtcttcccaccagcaggtcccagtcctgggaatgtccctcctcctgagagaaggcctcagtctggctgcagctgcccaggaggtcctcaggtagcatctcttgtgggttccaccttcgagccacagcctggagccagctcctcctgctctctcctccccatcccagctcagagccactcctggctcttccccttctgggcatcatccccaactccagccagcgggaccctcctaaggcaggaatcagaccacctcactcccctgccggccacctgccagtggctccctcactctcagaacaaaatctacttcttgatgtgacccgctgggcccctgagcttccgcagctctgacggctctgctgggctctgaagcacgctcactggaatgtcctgtcccagtgatttgcacggctcaagtgttgtctcctcggggcctggccactgtgtccaccgtggcgccactgctcgccctgtcgtcatggtacattctctgcttgaggacccatgtccctgtagaatgtacgttccccaagggcagggctttatcagatctttttacagtggtggtcctggcgctggcacagctactggcacgggatggatgcttttgagtgtagatccagtgagtaccccaccccgaacagtcttcgatgcataccagaggggaagcctcctggcatagctctgcatgcccaggctggccgagggtcatccgcctcttcctcttcacttcattgaaccagcagggtgtgggcggagaagcagaaattcacaggcatgttgtcagtaaaccagccctgttacctgttacagagcccagggcaccataccgttttgcgtgtgctgtctttagtgagtgagcaaaacctcagccctgcatgttaaagcaaaggcggcaaacgacagccgctctctccctgtccagctgtctgaagtggaagtgggggccaagcccgctgggttcccgctgccggcagccccgccctcctcctctggtagccgctctgcagctgtgcggaccagctctcttaacacttgttaaccccagcctccagtcccttcctgccccccaccccgccccttccacatgtctctccggagagggccgcacagaattcacaggactcgtctccaacggctgcgccagcaattccctagcattcctcctctgcagagtggattttggtgcatgtccagcgtgatttcagacccctcactgcgcagcggagtgcctgatcgctctgtgtgcaccaccacggtgcacactgaaaatattgtgatctgggaggaagtaaccagcaccttgggggaatcacagacctttcctgcgagggcaagggcttccggaattgaacaggctgggcctggaggagatcttgaggggtggaccttcaggcttgtaaaggcctggaggggggtcacccgaggatcgaggccgaagatgtttactgacgccacaactgtgaaattccacaggggtcaaagacggacccgggcgggagcggtctgggctggatatccggagagttctgctctccacgggatgttagaatttgaggcagtctgcctaaggaggcagagcagagaggcatgtgatcacccagatcgtctgagagcgggacattttcccggagcggggtggaaggagtgtcaaggtgactgtgagatgacagacacgtaggggagccccacagaggacccccaagacaccctctctgttgccatcagcctgagtcatcctctatctgaaaaacttccaggactgaagttcgagttggaagcacgcgttctccttggtgaagtccgtcctgtcccaggagggctgcgctaggtctctcctctggctccccctcctcgggtcctcgtggctctctgtcgtgtgaagcggggggtcaggagcgcacaaatgtttatactccacgtgagtcacttgcacagatgacgggtgatgttttcctcgccaaggctgatggcaccgggcccctttgccgttccagcctcagtcacgcctccagtctgttagcatttagagttgctgaactttcgcattggtcaggggcgcgggcagcttgctgaccttttctgggagtcgtggcggacggagtggagccgtctgtctcgtcacagacaggcggggctgcggctggggatggccgccgcccactcgccctcagaatggccctcagcggggcttcctgacccctcagccccggtaggaagctggtgtgcactgcagggagaggcggcagctggaaaagtgttaaggccacagtggtttttccagaggctcgtctggaatgccgtggctggatctgagcctcctgacatccgaggcccctcttggtggggagagccagaaacccaagatactgccgtcagttaaagactcgaagttcacattttaaaaagtgcaaggagacacccggttttaggtacgttggggtgcaaggtctgaaggctggaatctgtggctcccttctttcagctctgtcatccctcttgtctgggtgctgcccacctggtagaaaggggacctcaccttgccactccactagcctgccaacaccaccaggaaggcgacccttcatcctggtggctccagtaaaaatcccagggaaggctctgattggatcagaagggccaagtccccatcccaggatgaatccctatggccaggggccctggagcctctgtccagtctgtgtcacatccatattttcagcccagcaatgggatctgcctgatctccaccactggggctgagcatagagaagaggaggttccagaggagaacagggggcccttatgagaagaggggagggatggtaaacaccccaaaaatgaagatattcatgacagaccccctctgatgctgaaatttgtgttgtctttggaaggtgctgggctaagctgtggagtgcctgcatctggcctggctctgctggggatgagcagtgccatgtggcagccccgtcccttctggggcttcaacacctgtcctgccagtggaggcagtggggtgggctgccttgcagcacgttaccaccccgacatgctagaattcagcagtgctagaatttcactgggtttccaagcggtgctctggagctgtgcagtcatgtacctacttgcctgaactgtggagtgaagggatttgctcattcaagtggtccctgctgccggcccaatgcagtgggaccaagtcgggggatgggctgtggcagaagcagtctcacctcagtgggagggaatgggaaagggaagcctcaggccgagacctgcccactcgtcagccctggatggggacccagctgggccatgagggtgaggaaagccatggcagagaaggctctggggtggaggcagcagaggtgctgagtgcagaaatgctggtgggctcaggagtgtggtggagggagaagggtctgagggcaagagggttggccactcagcacagagcacaacatgagcaaaggtccagagacaggatgtgcaggagagtcccactgagggcttcgcggtggatcctgaaggatcacatacactaggactcgggccaggaggtcttgtggggaggaacaagcagtgagctaagataagagttgggctccagcaggccaggtgcggtggctcccgcctgtaatcccagcactttgggaggccgaggcgggcagatcacctgaggccgagagttcgagaccagcctggtcaatgtgatgaaacctcgtctctattaaaaatacaaaaattagctaggtgtggtagtgggcgcctatagtcccagctactcaggaggctgaggcaggagaattacttgaacctgggaggtggaggttgcagagagctgagatcacaccactgcactccagcctgagtgacagagccagactccatctcaaaaaaaaaaaaaaaaaaagagttgggctccagcccagtgctgccacctgggagccatccacctgccacctcactcattcactcaccctcaaaccccacctccctggccagcagcaagctctctgcctccacagcacccctcccatcctggcttgtacctggaccacagtgttggggcgtccccatcagaacagcctccacgaaccaagggagcacccactttgtataaggccatcaactggggtggtgcagttctggttcctggctccgttgtcggcaggcagcctagaaaaggggcacggctatcatcccattttacagatggggaagttgaggcacagagaggttcaggggctcatccaaggccacacagtaaacaagaggcagagggacactaggtatggccagcagagaccttctttggccagtgcacaggtgctttttggccttttcatggtcccaagtgggtgggtcctatgatcatcaccatgatgcagatggggagactgaggctcagagggctgagactgctcaccaaggctctgcctgagcctggaggatgcatgtggagctaaacagcaggaagagcaagacaggggctcttcagggccggcccagcacaaagatgtggatttatctgtccatctatccacccacccttcatccaccattcatctatctgccacccactcactccttcttacccacctgttcacacctatgtccaccagttcacccacccacctgaccatccatacctccacctgtccatccaccccaccacccacccacccatccgcccacccacccacctgcccctatccacccatcttttcatcagtccacccttccatccacccacccatccacctgcccttccatccacccacctacccatgccacccacccttccatctacccacccacccatccatccacccatccacccacccttccatcagtctacccttccatgcacccacccatccaccctaccatctacccacctaggcacccacccacccttcacccacccacccatccatccacccgtccacccacccttccatcagtccacacttccatccacccacccacccacccttccatctacccacctgcccacccacccacccacccttccatctacccacccacccacccatccatccgcccttccatcagtccacccttccatccacccacccacccttccatctacccacctacccacccacccacacacccaccctttcatctacccacccacctatccatgcacccatccacccacccttccatcagtccacccttccatccactcaccatccacctgcccttccatccacccacctgtccacccacccacccatccatccacccatccacccacgcttccatcagtccactcttccatccacccacccttccatccatccatccacccacctacccacctacccatccatccacccatccagccatccacccaccctttcatcaggccacccttccatccacccacccatccacctgcccactcttccatctatccacccacccattcatccacccacccacccacctacccacccacccatccatctgcccttctgtctgtcacccatccatctgcccttccatccactcatccattaactcatctactgcccatccaggcacccttccatctacccatccacctgcctaccactatccatctaccaacccacccacccatccaccaatccactcatccaccatctgcccactcatccaccatctgcccacccatccacctgcccgtccagccacccttccatctactcacctatcactatccatccaccaacccaccatccaccaatcctctcatctaccatccgcccacccatccatccacccatccaccaacctacacacctgtctgtccacccatccacccaccctttcatccatttattcacccatccatccatctacccacccagctatccacccatccattcatccgtccatccgttcatccaccca

SEQ ID NO: 424 - DNA, 8000 bp, Homo sapiens
  Locus number 36 genomic DNA region, protein kinase C, D2 type (nPKC-D2), protein kinase D2
gtccagaagctgcgttctcaaccccaccattgcccactttcctctttggcccttccattccccagaaccgtgccccacccatctagatctattctctcaaggacccgaggtgggaggacttactgtggggcgcgtggcctggggcgctgggtgcgtcctgaaggatgacgggcatcagggcctggcggatggctgtctcccagccccgggcggcctcagccccctgcccacttggcccacccggagtcccgccaggcatctcgcccacgaagtaggtggcattggcagtgacgatctcaaagcagtgtgggttggtgcccggcggcacaaggctgaagttctgggcggactccaccgtgaggatttctgacagcggaatttcctgcaggacgtggaaccagcacaggtgaggatgccaggcagaccttggaattctagtgcttacccagaaggatacacgggatccatgttgatagggatgggcctggtttgcacagtggtcagacaagttcccagtaattctaagcctgttctcactgttcttttataattactggcagaggccaggtgcggtggctcatgcctgtaatcccaacactttggaaggccgaggtgggcagctcacttgaggtcaggagttcgagaccagcctggccaacatggcaaaatcccgtctctactgaaaatacaaaaattagccaggcgtggtggtgtgcgcctgtaatcccagctaatcgggaggctgaggcaggaaaatcgcttgcacctgggaggcggtggttgtaatgagccaagatcgcaccactgcactccagcctgggcgacagagtgagattccgtctcaaaaataataataataatactaattactggcagaagtgatattgaagcagagaccagaaaggtaagaagcagccagttggcaaggagtaggggaacagcatgtgcaaaggccctaaggaaaggctatgctcaaaagccaagctgtatccccatcacatgggcggtgcctggacatagtaaaagcttgataaacatttgatggccggatgtggtggctcgtgcctgtactcccagcactttgggaggccgaggtgggcagatggcccaggagttcaagaccagcctgggcaacacagtgagaccccagctctacaaaaaatttaaaaattaggcatggtgccacaagcctgtaatcccagcactttgggaggccaaggcaggcagatcgctggagcccaggagtttgagaccagccagagcaacacaatgagacccccatctctacaaaaaataaaaaaactagccaggtgtggtggtgcgcacctgtaatcccagctactgtggaggtgggagaatcatttgagccagggaggcagaggttacagtgagccatgatcatgccactgcacctgggagacagggcaagagcctgtctcaaaataaataaatgggctgggcatggtggctcatgcctgtaatcccaacactttgggaggccaaggcaggcggatcacaaagtcaggagttcgagacccgcctgaccaacatggtgaaagcccatctctactaaaaatacaaaaattagccaggcgtggtggcacacctataatcctagctacttgggaggctgaggcagaagaatcacttgaaccccggaggcggaggttgcagtgagccaagatcgcgccactgcactccagcctgggtgacagagcgagactccgtctcaaaaataaacgtttgataataaatggaggaaatgaggccacacagggctttgcgggccacaaggaagagcctgggctttgtccaagggccctaggaagccactgaaggcttttgagcatcatccgcttgtgtgcggagggcagatggaatagaatgagatggagacagagaaccaggaaggaggctgaggggacccaggcgggacagaaggcacagggactatggggtgggaaacgtgtcaaaagaggaaggagggaggtaggagagaggaaagaatgaatgacttaggcagcccataaaaccaggtgatgacatggacacgtcgggggggcatggtgaggacagcattatattttattttattttatttttttgagatggagtcttgctctgttgcccaggcaggagtgcagtgacgcgatctcagctcactgcaacctccacctcccaggttcaagcaattctcctgcctcagcctcccaagtagctggggttataggcacccgccaccatgcccagctaatttttgtatttttagtacagacaaggtttcaccatattggccaggctggtttcgaactcatgatctcaagtgatccgcccacctcggcctctgaaagcgctgggattacaggcgtgagccaccacgcctggccaaggacagcattttagatggtgtggtctgagcaaaatgggaagatgataaggaaccagccatggaaagttcaaggaagacgctccagggcaggtaacagctggagtccaggttttattactctaagacaatgggagccactggggggtttgacggttttaatgaagactcccctggctgtgggggaaatgacagaggttgtgaggtcagaagcaaggaccctgcaaggagaaggctgaaaccatccaggtggaagacagtggctgggacacagtgtgggcatgggaggtggtgacgaatacgcacacaatgcaatacattaattataaagaaatagtgaggccgggtgcggtggctcatgcctgtaatcccagcactttgggaggccgaggggggcagatcatgaggtcaagagatcaagaccatcctgtccaacatggtgaaaccccgtctctactaaaaatacaaaaattagctgggtgtggtggcattcacctgtagtcctagggtgggaggctgaggcaggagaatcgcttgaacccgggaagcggaggttgcagtgagccgagatcgcgccactgcactccagctgggcgacagagtgagactctgtctcaaaaaataaataaataacaaaaaataaaggaatagtgagaacagccttagaattactgggagcttaatatataccacgccttaagccaattggtttagtggattggctctttgaattctcgcaccagccctgaggtgagtattagcatttgaggcattttgcaggtgagaagcgtgaggcactgagaagtaagggaacctgcccggagtccccctggctggaaagtggtggggccagaatcggatgggcagcacttgctgatgagctggaagcagggaggctgggggtgggcagagggtgtgatttgcaggatctgtctggagtaactgggggtaggaggaggtgtgggaaagtttgtgggcacagcgggaagtccgagggagctgaaagcccggaggcttaccttatagtatctgttggtcgtgttgttctggaagagcgtgatacacttgcagtccaggcgccaatagtgccgctttctctgcagagatgtttgaagagtcacgtgaaccgccagactttcctgcccagtccctatcccgtggagctgcttggggctccaggtgcctggagcaccacgtgcacgccgtaactctagcacctaccccacgccgtaaccccaccccaccacacgccctaaccccagccccgcccctagccttaaccctagcccagcccccacgccctaaccccagactcgcccccacttagccctcttcctccagccaagctcctcccctaactctagccccgcccctgaccttgccctgagccccgggtcttccctaactcctgcccgtagtcccacccttacagcccacacttctaattctagccccgcctccagcacggcccagcccactactggccccgctcgcgcctagctccagccccacccacctagccccgcctactcaagctgagccgcccctcttccagccttcgctccgccgtacccggccccgccccggccactcaccagcgtgtccttgttgctgtaatgaaccacccaaccctcccgcagcgtggtgctggatttccgcgtcgtgtgtcgcaccgattgcaccaccctcattagggggatgtaccccagggagctgcgaaggaagaggaaggggtgagaagtcacatgcagaaagtgaccatgctgcttgggaatgcagggggcatctctgggaaactagggagttggggactgtttttgtttgtttggtttgttttgacattttccccccaacacacacccgggagttgctttttgtttgtttttaagaggctcgctctgtcacccaggctggaatgcagtggtgcgatctcggctcactgcaacctctgcctcccgggttcaagcgattctcgtgcctcagcctcctgagtggccgggacaatcacggtgaccattaggtgcacgccaccacccctggctaatttttgtatttttagtagtgatgaggtttcaccatgttggccaggctggtctcgaactctttgcctcaactccttccctaactcctgcccctagtcccacccttagaatcccttcacgagatccatccgcctcggcctcccagagtgcttacaggtgtgagccaccacgctggcccagaaggagattcttgagagggcttctgtagtaggcctttctgaagtcaggctgcctagcaaattacctaacctcttcatgcctcagtttgtccacccaaaggggatgctatgaggaatggaaacctttctacggagcttagtacagtgcctggcatacagaggacctccagtaagtgctaattggtatttagtccagcaattgtggagccagctgtgtgacactgggtaagtgattcaacctctctgggcctcacctccctcatttgtgcagatgctgttagtacagtaaggaaggtctacagagattaagtggcctgctgggcatggtggctcatgcctgtaatcccaacactttgggaggcagaagtggggggatcacttgaggtcaggagtttgagatttgagagattaagtgacttgctcaactctggaaccaacaatctctggatccctgtgctagatcagaacctgggtggccttgatcacatctctttgcctgagactcagtttccccatctgtgaaatgggctgcctctccccacacccgccacccccaatccctcaaggtccaactcttgacagtgtatgacggtgttactaggcattcccaggaaagacgtgggagaaagggaacctgcggcttcaggctgcttgggttgggaggcaccgcaggaaacactctgtcgtcactgtgactggcttacccatcccctttctgtccaaccctcttcccctcgccctccctgctgcagctacatgggtctctttgctgtccctggaacacggtgcctccaccccagggcctttgcactcgctgttgcctctgcctggaagccttttcccccagagccccacaaggctccttccctcccctcccttcaactgccacttcctcagcgaggtctccttgaaggaccctaagatagcatgtcccccattctccatctcctcttgtttttatcaccattaccaatacccgatgctatggatgcatttattagctgtctccccactgaggcagtcagctccagaagggcagacttttacctcttttgttcatagctgtgtgcttgaacacagcaggtgctcattaaatattttccagtgcacctgtgagggtgcccccttacccctaccccaggtttatcaccccgtggggtaggtacctcatcgccccaggaggaaaccgtggcacacagggaagcgcctagcaagtgaagtggtagagctgggatctgggctgtcaccctccagcgcctgtgtgaactgtgctttctcaataaacattcacgccacacccagataggaagtgcctgatctgagccagtcctgtcctaggcacctgggagggcagaaaatatccttgccctcatgcacctgagctcacattccagtggagctgactaagtatgaactccgtgtatagtttaaaaatgtgtaggctgggggcacagtggcacacacctgtaatcccagaactttgggaggctgaggtgggaggattgcttgagcgcagaagttcaagaccaccctgggcaacatagcaagaccccctatcttaaaaaaaaaaaaaaaaaaaaaagaagaggaatataggtcaggcgcggtggctcatgcctgtaatcccagcactttgggaggccgaggcaggtggattacctgaggttgggagttcaagaccagcctgaccaacatggcaaaaccctgtctctactaaaaatacaaaaaaagtagctgggcctgggcgggtgcctgtagtcccagctacttgggaggctgaggcaggagaatcgcttgaacccaggagacagaggttgcaatgaactgaaattgcatcactgcactccagcctgggcaacaagagcgaaacgccgtctaaaattagccagggatagcagtgcatccctgtagtcccagatactcgggaggctgaggcaggaggatcacctgagcccaggagtttgaggttacagtgagccacaatcacaccactgcactccagtgggcaacaaagcaagaccctttgggaggctgaggcgggtggatcacttgagctcaggagtcaggagttcaagaccagcctgggcaacatagggtagaccctgtctctacagaaatacaaaaattagctgggtgtggtggacgagcctgtggtcccagctactcgagaggctaaggtggcaggatcgcttgagcccaggtggtcgaggctgcagtgagtcaagactgcaccactgcaccagcctgggcgacagaccgagaccctgtctcaaacaaaaaattatttaaaaaaaattgtagtgctttaaaaggtttgcctcaggaactgggaaaatttataaatatgaggtgatgtcagcccattgtagagaaaaagaaattgaggttcactgtgcaggagggtcttcccccagggtctcttggagggttctgtgtatacctctgggccttgcctccctcgccttcctcctcctcactggcgtggagcgcattctctgagtgggagccagggatgacaccggagtcctctgactcatccatgagggcgctcttgtcagcctcgctgaaatcggtggcctcctccatcggcacatctgtggggacggaggcatcagaggggtctccacccagtcctgccccttcccctttctccccagcatccccccagcctctcacctccattgataagggcctcccccaggcagtcattagggacgcgggtggcgcagcgtttgtgacagttaaacttgcagtctggtaggacagggaacaagggaacgggtgagaaggggaagagaggttacctggaaggcttgaaccttgaccctaagcctcaggctcaaaagagtctactcttgctgtctgggtaagaacactggctgctgctgccctggtcattttcccactttcagccacagttttcccaaccatcgggggggtcttgattaagtaggagggctagactcaaaatcccgacgactgctgggtgcagtggctcccgcctgtaatctcggtattttgggaggccggggagagcagatcatttgaggtcaggagttcgaaaccagcctgccctacatggtaaaacctcgtctctactaaaaatacaaaaattagctgggcgtgggactacaggcgcccactaccacgcccagctgatttttttgtgtttttagtagagacggggtttcgccatgttggtcaggctggtttcgcgctcctgacctcagatgatccacctgccttggcctcctaaaagtgctgggattacaggcgtgagccaccgcgcccgacttgtgtgtgtgtgtgtgtgtgtgtgttattggttctaatgtgctgtgactccagactctgaacaccctagggctgggttcctcaacccgtgacactaac

SEQ ID NO: 425 - DNA, 8000 bp, Homo sapiens
  Locus number 37 genomic DNA region, neuronal membrane glycoprotein M6-b (M6b)
tttccacatttaaatgttctaaaaaaaaaaaaaaaaaatcaaaggaagctgtatcatacctaccacatatgttccgcaccatctggccagccacttttctctacagcctattccccagacaccaactcttcagatgtccaccttggcaaattcttacagataataactgcatctaaaacttcctctgtaccatatttatatagccaagttagaaaatgtcaacacaaatttcaaaatgcaataattcgcagatcatcaggaatagtgtgacgtgtgttatgtgtccctttgggtttttaatcacacaagtcgtatattctagaggagtgcttttcttcctaaacgaaaaatgagagccaaaagtgcatacattttgctaaattaaaaaaaaaaataagaaattatatctatttgatcaaaaagattaaaatagatgtattaattttttaaggaagtcaataatttaaattcatttcttactttgactatatcctgtaatttattttaaattacacattgtttcccattcactatatttttcttcctgtgtggttaggaatttaatttgatgcctgtaatttatttcagcaacgattcataggaagttaactaacctgactataattgtttcagtagaattcaattacctacatataatgaaaataattttcataacagatagatttttcccccataatagagcatacaaagttgttatgattcaattgtttttctactcagtgattatccactctcagcaatttcagatgcatttattttcacaaatgaaatgacaacaagtaatactccactgaaatcaatggaaaccgactctccatctttttattattgggttccatgatctatttcttttgattctgtcttattcatttcctctgcttattccatgtcagtgaatctgcttactcaatcttcacactttaatgcttttaatttaaaaactatcatttgtaataatttggcatttcttacatccatctaagaaaatctgcttgttttccttaaaaatccctaaatatctactaaatactcttgtgaattttggtatctggtagcatgctgtgatgaaaactatcagactgaaaaaacacaaatgctttccttttttaaggacatggattaattttgtctaaagtagaaacaaagtcattgtgattaagtttaaagaaagagctctctttgtaggagttagtgaatcacaatagctgggttgtgttgtcccgctgaaactcccaggaaagatcccaactagaaaagcaaggtcaatttataaagctaagtttaatttacattcttagttcttaatagacactgcaataattatccaaagatattaattcacatgctattgggtattagccattgggcaataatgccccaaattaagagacaggcatcactccatcaccaaccactgaaaacagatgggaaaggagaaacacaggaaaaaaaatatatatgtgcataaaaaactctgcgtaaagtgacaaaatttacaggattaaatttaatgaataaaatcctttgctgaaaggcttaaaagaaaaacataaaaaacggatccaccagctcaagaattatataacacattctataaataattatgtcaagttttcaaatgttaatttcaatggaaaaataattttttaataaacttaaagttaaatctgaaggaatactgatgtgacaatcacgcagaaacatttgtggctatcattttatcctatgtgtaccttaatgatgatgggtgagcaaattgggaaactacaaagtgtcttgtgtgggctttgattttgtgtagccagcatatgaacttgttcatctaaatgcagattagataagccaccctccagatcaacaattatggtgggtcacacaacaatcacaacccctcttgctgtagatcaggaaaaacaaatcccctggcttgtattcttattcaagcatgtaccatacatgtcacactagcttctggtagtgtgatatttttgaattatttaacaagcagctagtgtttatacatttaggtaatttttaaagttccttcacaaattatcttttgcttctaattttgtctctaaaatcacaactaatgacttttcatatacgggttgtcagggatgtactagcaacctgtagatctgttattaaataagatttaattgacataaaataatagcagtccataagactaagtgataagatacacagttgtgtagtaatgattttatattggttatatgacctttgcttcctttcagagagaaatttaaaaaagggatttttttgcaaagaccaaaacggttttatctgccatggttgaataccacattaataaaaattaaaagtatgtactaagtaaaatcatcattttaggataaaatcgtgataggcttccttgggacaatgctattacattatcataccccgacaacatgcaatcaacttagtctctagtcatcatggaaaaaactttgatctcacttcttcatcttgataaatattcccaagagcttctcttatagctatttggtcattgatgaagattttttttttttaaagacacacaagaaaatacaggctgggtttttggtggggaggtgtagatttggtaagaggattgaactaaacaaacgattttaaaattaaggtgctatgtacttaatgccactgaatcgtatacttaaaatggtaaattttatgttatgtgtattgtgtgatacctaaaaaaattaatttaaaaagtaaaattgctctgtttaggataaaatattattgtgtaccaaagaaattttatataaaaacaagcagtctttaccccagcatactgtgaagctgaagtacatgtaattgccgtttttgtaggtttaaaatggttgactatcagcaatttcatatggttcagcctgtatctttataaataaaacgaagttttgtccccgtactggcgaattactctttagtgactatcagtggacgcaagggctgtgagaaataaccttagcatgatggctttttatattagagccactgcggttacagaatatgtttttgggcatttatgacagtctatgactttgagtgagggaaaattacaatgcagtgagatccattaacctaacagtggctgagccgattctatgggacatcaaacttgaaatcagtcattatttagaaaaaagagattaattttagttcctttctgccattttcttactgcaaaaacactttattctccaaaaaaccattctgtatatgaaaattgtggtacgttctaagattctctttaagaaataggacctttatcaattttcttccccccagtctccaagtcataattagcagaagatcccccgccctgcctttccatcagcactgggtgacagagctgatgtcccctctctgaagctccaactgtaaatgattattacatgtcgtagtcagggcctgatacaagaaagagcaatcatattagaataagaaaattagagaatgcccaaatcactacagcattagcggaaccaaagcagaattaacatgcatgcccctccagttcctcctcagcattagcagaaaactacacattccacgttcctggaatataacatgcaggacacaagacctaagttacgattaattatattaataaaaaaagacagtttccccaatgcatcagcccaaggtgacaaactatagacatccctctatgaaatatcacgtcggtagaaagatttggaacaggaatggattgaagaaaggctgctctattaacttaacatcagcccacaggaaaaaaatcaaccctgaaagcaagaccatgccatagggattgtctcagagccattttaaaagagagacaaaacccagctaaccctttttaagcaccccccagtgaaaagctttaaacaggctattgtcagagcgctgggtaccttttctctcttggctttgttcagtattttcctcggctgcagtttccatggctggcttcataccatccaccaaaaatgcttttccccctgttccccccaacacacacttgtttttcctcctcttccttttcttttggactcccctccgtctcttatttacacccgtctgattgagaggctctgttcttcactacagtagattacagtcccttccaagatgcaaaagtcttgtcagcgtcaatttcgctctgcctactggtccataaagacagctgccaaggggcaggcagccatacgtcaccgaggatcccagttagaaaacagccattcggcgcccggtggtgcctacagtctcaatgcggctccagtgggagttgggggtaggggggtgggggagaaggacctgctccccaccgggctcttcctccttgctctctttcttaagatctcaatctcgatctctctctctctctctctttctccccacctcatttcttctagccaagtacacccaatgaatgctaattaattctcccaggaaaaaatagatttgtgacatcagaggaggggatgtgaaggagaaagaaaagagccccctcccaccacgtgactttgttggtcgacagcaatatatgtcgtctctaaggagaatgcatgtctttgcataggcatgacactttctttcctgtgtggtccatttatgatgtatcagtttatttcatttacccctcgaccctggcaaaacatattcaaaggacgtgcccatagtctctatttactttcttaaatatttgtctttcatacaatttctagataagtacattgctttttaaaaatataaattaaagagggggagaaaatacattagagggaagaaaactcaaacacggatttaacgatagcaatgtagcaatttgttattagaacccactcccttgtctatagttaatatatatgatagtaagagaaactcaagcctaatttgtaaaaaggcacccttccttatttaaaaataagcataacatgttcacaagtatatcgagctgacattttggtagtttcttggaatgaaaatcaaaatagttttttaatcggatatggttatttctacatggagttttactcattagaattcctcactccaaatcgaaggggtgttttcaagagctctctaaatattcaacataaaggctagtataccaataatgatttgccttcttgcatacccagataccatgaggccaacattctcaacccataccaacatataagcctttatcatgattatgagccatgtttccaagcatcactaatttctgcaccattttttatgcatttggctgaccaactggccttcgccgtccctataaaaaattagagagactcaagtcaaatacagggatgaccactgataggattcccagatcatgaatagtctgctagttggttgggcttaacacttatcttggaagcaaacataaagacaagttggagaccaccctctcctaaaatcactctcctaagttttgatggtttcttgctcaactccttgaaaaaaaagtataaggtactgaatcaaaatcttctaaaaacctgatcttttaataccttggttttagataatccctcaaaccttcttatatttagaacttctagatgtgttacagtcgagaagattttgaaaaccagtttagcttgtttcaacgtttaattttacatcttgcttttccctttaccattgtcttagaagaccacgcccacaatcaaatatgtattccctcaaattaaggccccagccaattttattgtctcctggtcaggggattgagaagtatggcagcctaaaaccacagactttagaaaaaagattcgtttgtgatataattatttccatgggaaaaccctatggtgtgtccggataggacagtcttagacattttttgcaaagactacttaggtccattcaaatatagaaaggtggcaagtgttggtatgtaacaggcttgctttcccagcagttcaaatgagaattaaaaccaaaacaaaattcaattcagcacaaaagaggacactgtgattagctgttattggtttttaaagtgtccagcaaaaacatctgattatagaaccagcagatcctaataattttttggctgttgcttaagaatattattttaatagtgatgctggtgaaaaggcagaatatgaaagacattcttaatttaagaacaactctagttctatatcgagatcaaaaccattagacaaaatattcacacatcctccagttgatacctgcatctactttccacctgaaaaactacatggaaatgagcaattcatcacttttgcctgattcacaacttcatcattttcttttcactaggataatgtattacaattctagaaattaccattatatcactttataacagcctcaagatctcactgatgtttatgataaaccatttgaaaaacaattgtcaagaggaagagagaagagtattgcttattacatttctgagatatgcatccatttttggccagaaaagttctatatgtagaagtaggatggaaaatgtcttccagagctgaaaatatttctttgagccccatgctctaaggcagtctggttgaaggtaagaacacttctgaaagccaaaacaggaatacaaaatactgaacaaaacagattagaataaacatatgaaattgctgatattgaccaagaagaacagcagtttcacgtggtttgacttatatgtttgtaagtcttctgtataattgcagccagctcagtaaacatgcatgaagtaacctccctagtgccaacatctacaagcagcacagacatgcacaagtgacgatgcctgtctccaggtaacccacggctaatgggacacagaaaactcttctaaaacagggtgctcctgcctgccacaagcactatggcatcacaacaaagaaaatggatggagggggaagagaatttgaaaaaagctttgcagagttgagttggctattgcagtaatgcttagaaacctgctgggtagggtagggaagggaaaagcaggaaagaggaacggaaagagttctaggaaaaactgaagggcatatgagaggaaaaagagggtactgtcaaagggtcaggaagtgatttttctgacagagggactgaagggagatggctgagccagtaggttgggaaccaggtaggttgaacaccttgctagccctagaggcagtaggtagagatagaaggctcaagagcagagctgatcgtgctttacaaaggtcattctattggtaacgtggaagacagggtgggtggagtatgagactagaggctggcaaactagtcaggagtctcctgcaacagtaccagtaagagatagtgtgaacctgaactatggcacggggaggaagtgaggacccagatgtcattggattggatctgtatgagtaggggtggaggaggatttgaaggggaggctagagtttctagcttgggtgagtgaggagatggtcatgctgggaaccaatatggggaaccaaagagaaggaagaagtttggtaggggagattatcaagcgtggttgaaggtgctcttaggacatcctgcagggactaagaggcattcaggaatatggctccagaagagaggagctggccagagagcagcatccgggagtcttcagtgtggaggcagccctgggagtacaagaagcccagttctgctcaaatgccatcttctcaggggactctccctgactcttgtctaaaatagcagccctgacattcctggtccccttaatctggatttgagtttcatcatagctttaaccacgactcaacactgttattcacttatttgttcatcacttcccatcctcctagaatacaggctccttaaaggcagaaattgttgtcttattctccactgtattctaagagctcttggaacacttctgggcacatagcgggttctcaacaaaatctattttaaatcaatgttaaacaaccagggagagatacagatttcaagta

SEQ ID NO: 426 - DNA, 8000 bp, Homo sapiens
  Locus number 38 genomic DNA region, neuronal membrane glycoprotein M6-b (M6b)
aatttaaattcatttcttactttgactatatcctgtaatttattttaaattacacattgtttcccattcactatatttttcttcctgtgtggttaggaatttaatttgatgcctgtaatttatttcagcaacgattcataggaagttaactaacctgactataattgtttcagtagaattcaattacctacatataatgaaaataattttcataacagatagatttttcccccataatagagcatacaaagttgttatgattcaattgtttttctactcagtgattatccactctcagcaatttcagatgcatttattttcacaaatgaaatgacaacaagtaatactccactgaaatcaatggaaaccgactctccatctttttattattgggttccatgatctatttcttttgattctgtcttattcatttcctctgcttattccatgtcagtgaatctgcttactcaatcttcacactttaatgcttttaatttaaaaactatcatttgtaataatttggcatttcttacatccatctaagaaaatctgcttgttttccttaaaaatccctaaatatctactaaatactcttgtgaattttggtatctggtagcatgctgtgatgaaaactatcagactgaaaaaacacaaatgctttccttttttaaggacatggattaattttgtctaaagtagaaacaaagtcattgtgattaagtttaaagaaagagctctctttgtaggagttagtgaatcacaatagctgggttgtgttgtcccgctgaaactcccaggaaagatcccaactagaaaagcaaggtcaatttataaagctaagtttaatttacattcttagttcttaatagacactgcaataattatccaaagatattaattcacatgctattgggtattagccattgggcaataatgccccaaattaagagacaggcatcactccatcaccaaccactgaaaacagatgggaaaggagaaacacaggaaaaaaaatatatatgtgcataaaaaactctgcgtaaagtgacaaaatttacaggattaaatttaatgaataaaatcctttgctgaaaggcttaaaagaaaaacataaaaaacggatccaccagctcaagaattatataacacattctataaataattatgtcaagttttcaaatgttaatttcaatggaaaaataattttttaataaacttaaagttaaatctgaaggaatactgatgtgacaatcacgcagaaacatttgtggctatcattttatcctatgtgtaccttaatgatgatgggtgagcaaattgggaaactacaaagtgtcttgtgtgggctttgattttgtgtagccagcatatgaacttgttcatctaaatgcagattagataagccaccctccagatcaacaattatggtgggtcacacaacaatcacaacccctcttgctgtagatcaggaaaaacaaatcccctggcttgtattcttattcaagcatgtaccatacatgtcacactagcttctggtagtgtgatatttttgaattatttaacaagcagctagtgtttatacatttaggtaatttttaaagttccttcacaaattatcttttgcttctaattttgtctctaaaatcacaactaatgacttttcatatacgggttgtcagggatgtactagcaacctgtagatctgttattaaataagatttaattgacataaaataatagcagtccataagactaagtgataagatacacagttgtgtagtaatgattttatattggttatatgacctttgcttcctttcagagagaaatttaaaaaagggatttttttgcaaagaccaaaacggttttatctgccatggttgaataccacattaataaaaattaaaagtatgtactaagtaaaatcatcattttaggataaaatcgtgataggcttccttgggacaatgctattacattatcataccccgacaacatgcaatcaacttagtctctagtcatcatggaaaaaactttgatctcacttcttcatcttgataaatattcccaagagcttctcttatagctatttggtcattgatgaagattttttttttttaaagacacacaagaaaatacaggctgggtttttggtggggaggtgtagatttggtaagaggattgaactaaacaaacgattttaaaattaaggtgctatgtacttaatgccactgaatcgtatacttaaaatggtaaattttatgttatgtgtattgtgtgatacctaaaaaaattaatttaaaaagtaaaattgctctgtttaggataaaatattattgtgtaccaaagaaattttatataaaaacaagcagtctttaccccagcatactgtgaagctgaagtacatgtaattgccgtttttgtaggtttaaaatggttgactatcagcaatttcatatggttcagcctgtatctttataaataaaacgaagttttgtccccgtactggcgaattactctttagtgactatcagtggacgcaagggctgtgagaaataaccttagcatgatggctttttatattagagccactgcggttacagaatatgtttttgggcatttatgacagtctatgactttgagtgagggaaaattacaatgcagtgagatccattaacctaacagtggctgagccgattctatgggacatcaaacttgaaatcagtcattatttagaaaaaagagattaattttagttcctttctgccattttcttactgcaaaaacactttattctccaaaaaaccattctgtatatgaaaattgtggtacgttctaagattctctttaagaaataggacctttatcaattttcttccccccagtctccaagtcataattagcagaagatcccccgccctgcctttccatcagcactgggtgacagagctgatgtcccctctctgaagctccaactgtaaatgattattacatgtcgtagtcagggcctgatacaagaaagagcaatcatattagaataagaaaattagagaatgcccaaatcactacagcattagcggaaccaaagcagaattaacatgcatgcccctccagttcctcctcagcattagcagaaaactacacattccacgttcctggaatataacatgcaggacacaagacctaagttacgattaattatattaataaaaaaagacagtttccccaatgcatcagcccaaggtgacaaactatagacatccctctatgaaatatcacgtcggtagaaagatttggaacaggaatggattgaagaaaggctgctctattaacttaacatcagcccacaggaaaaaaatcaaccctgaaagcaagaccatgccatagggattgtctcagagccattttaaaagagagacaaaacccagctaaccctttttaagcaccccccagtgaaaagctttaaacaggctattgtcagagcgctgggtaccttttctctcttggctttgttcagtattttcctcggctgcagtttccatggctggcttcataccatccaccaaaaatgcttttccccctgttccccccaacacacacttgtttttcctcctcttccttttcttttggactcccctccgtctcttatttacacccgtctgattgagaggctctgttcttcactacagtagattacagtcccttccaagatgcaaaagtcttgtcagcgtcaatttcgctctgcctactggtccataaagacagctgccaaggggcaggcagccatacgtcaccgaggatcccagttagaaaacagccattcggcgcccggtggtgcctacagtctcaatgcggctccagtgggagttgggggtaggggggtgggggagaaggacctgctccccaccgggctcttcctccttgctctctttcttaagatctcaatctcgatctctctctctctctctctttctccccacctcatttcttctagccaagtacacccaatgaatgctaattaattctcccaggaaaaaatagatttgtgacatcagaggaggggatgtgaaggagaaagaaaagagccccctcccaccacgtgactttgttggtcgacagcaatatatgtcgtctctaaggagaatgcatgtctttgcataggcatgacactttctttcctgtgtggtccatttatgatgtatcagtttatttcatttacccctcgaccctggcaaaacatattcaaaggacgtgcccatagtctctatttactttcttaaatatttgtctttcatacaatttctagataagtacattgctttttaaaaatataaattaaagagggggagaaaatacattagagggaagaaaactcaaacacggatttaacgatagcaatgtagcaatttgttattagaacccactcccttgtctatagttaatatatatgatagtaagagaaactcaagcctaatttgtaaaaaggcacccttccttatttaaaaataagcataacatgttcacaagtatatcgagctgacattttggtagtttcttggaatgaaaatcaaaatagttttttaatcggatatggttatttctacatggagttttactcattagaattcctcactccaaatcgaaggggtgttttcaagagctctctaaatattcaacataaaggctagtataccaataatgatttgccttcttgcatacccagataccatgaggccaacattctcaacccataccaacatataagcctttatcatgattatgagccatgtttccaagcatcactaatttctgcaccattttttatgcatttggctgaccaactggccttcgccgtccctataaaaaattagagagactcaagtcaaatacagggatgaccactgataggattcccagatcatgaatagtctgctagttggttgggcttaacacttatcttggaagcaaacataaagacaagttggagaccaccctctcctaaaatcactctcctaagttttgatggtttcttgctcaactccttgaaaaaaaagtataaggtactgaatcaaaatcttctaaaaacctgatcttttaataccttggttttagataatccctcaaaccttcttatatttagaacttctagatgtgttacagtcgagaagattttgaaaaccagtttagcttgtttcaacgtttaattttacatcttgcttttccctttaccattgtcttagaagaccacgcccacaatcaaatatgtattccctcaaattaaggccccagccaattttattgtctcctggtcaggggattgagaagtatggcagcctaaaaccacagactttagaaaaaagattcgtttgtgatataattatttccatgggaaaaccctatggtgtgtccggataggacagtcttagacattttttgcaaagactacttaggtccattcaaatatagaaaggtggcaagtgttggtatgtaacaggcttgctttcccagcagttcaaatgagaattaaaaccaaaacaaaattcaattcagcacaaaagaggacactgtgattagctgttattggtttttaaagtgtccagcaaaaacatctgattatagaaccagcagatcctaataattttttggctgttgcttaagaatattattttaatagtgatgctggtgaaaaggcagaatatgaaagacattcttaatttaagaacaactctagttctatatcgagatcaaaaccattagacaaaatattcacacatcctccagttgatacctgcatctactttccacctgaaaaactacatggaaatgagcaattcatcacttttgcctgattcacaacttcatcattttcttttcactaggataatgtattacaattctagaaattaccattatatcactttataacagcctcaagatctcactgatgtttatgataaaccatttgaaaaacaattgtcaagaggaagagagaagagtattgcttattacatttctgagatatgcatccatttttggccagaaaagttctatatgtagaagtaggatggaaaatgtcttccagagctgaaaatatttctttgagccccatgctctaaggcagtctggttgaaggtaagaacacttctgaaagccaaaacaggaatacaaaatactgaacaaaacagattagaataaacatatgaaattgctgatattgaccaagaagaacagcagtttcacgtggtttgacttatatgtttgtaagtcttctgtataattgcagccagctcagtaaacatgcatgaagtaacctccctagtgccaacatctacaagcagcacagacatgcacaagtgacgatgcctgtctccaggtaacccacggctaatgggacacagaaaactcttctaaaacagggtgctcctgcctgccacaagcactatggcatcacaacaaagaaaatggatggagggggaagagaatttgaaaaaagctttgcagagttgagttggctattgcagtaatgcttagaaacctgctgggtagggtagggaagggaaaagcaggaaagaggaacggaaagagttctaggaaaaactgaagggcatatgagaggaaaaagagggtactgtcaaagggtcaggaagtgatttttctgacagagggactgaagggagatggctgagccagtaggttgggaaccaggtaggttgaacaccttgctagccctagaggcagtaggtagagatagaaggctcaagagcagagctgatcgtgctttacaaaggtcattctattggtaacgtggaagacagggtgggtggagtatgagactagaggctggcaaactagtcaggagtctcctgcaacagtaccagtaagagatagtgtgaacctgaactatggcacggggaggaagtgaggacccagatgtcattggattggatctgtatgagtaggggtggaggaggatttgaaggggaggctagagtttctagcttgggtgagtgaggagatggtcatgctgggaaccaatatggggaaccaaagagaaggaagaagtttggtaggggagattatcaagcgtggttgaaggtgctcttaggacatcctgcagggactaagaggcattcaggaatatggctccagaagagaggagctggccagagagcagcatccgggagtcttcagtgtggaggcagccctgggagtacaagaagcccagttctgctcaaatgccatcttctcaggggactctccctgactcttgtctaaaatagcagccctgacattcctggtccccttaatctggatttgagtttcatcatagctttaaccacgactcaacactgttattcacttatttgttcatcacttcccatcctcctagaatacaggctccttaaaggcagaaattgttgtcttattctccactgtattctaagagctcttggaacacttctgggcacatagcgggttctcaacaaaatctattttaaatcaatgttaaacaaccagggagagatacagatttcaagtatgccaagattagagcttagggtacactaccttttaaatgtaaaggtaaaggaaaaactttaaaaagagggtaaaagaaacaaagaaggacaaattagaaaacgagggaaataagaccaaagtggaatcatgaaattcgagaaaggttctgtgaagggcatcaagttaacagtgtagaatagtgtcaaataccataaaaggaggaaaaaggatgaggactagcaagcagaaaggagttttaccaccaaatagcctttggaacttctgtgagaaggctgaatgatggggaaggatataacacttcccagtctctttcacgatcaccctcaaaataggaggctcccaaggtccagttgacatgttaaactcatacatagggctttggctgatgcctgtacatcttggccctgtttttaacctggcaagatcatattggatttttcttctgtgatctattacat

SEQ ID NO: 427 - DNA, 8000 bp, Homo sapiens
  Locus number 39 genomic DNA region, cyclin-dependent kinase 4 inhibitor A (CDK4I), p16-INK4, p16-INK4a, multiple tumor suppressor 1 (MTS1)
gtgagccgagatcgcaccactgcactccagcctgggcgacagagaaagactccgtctcaaaaaaaaaaaaaaaaaaaaaaaagttgttttctgctatttcctgaactttattacgtaaatgagacacgtgagatctggaaggaggtggaggtgaagaccctcccacctggcctgcatccagagtacttggggtgtggcactggcgtgggccccaggaaggatcccagccagttttggtgctggaggcccggccaaaggaagggctgctctcccgtcccgcgggctccgaggtcgccgcacccgggcgcgcctgggcctcgtcacccgcgctcgtgacgcgtgcttacaaaggaaacttttacaggtttcggtgggcagggccttttattgcccttctgctccacagcccccgtgcttaatcggttggttgggaggtttctttcgtccgtggttttggaaagtccccgcctccaaaccgcagtcccgcagtcagttctgcagcctcagggcctcgaacagccatgcttagaatccgtccttctttcctgctccatctacccttcccctctggcttcttttttttcactggagaaagcccacccgagtctctcagcctgcttcggaggttactgcggcctcctccacgggtagttctgggacccgggtctagtccgcggttccggagcaggtccctccctggagtcgtcaggcccagtatgcgtgtgctcagtgtgctcgggaaacacgcgtgggctttaacagcagatctccataaaagggtcccggagatagcctctgcctggcccgaggcccagtgcctcaaagcggacgcctttgcgctcccggaggtgctcacaccacagcggagcctgctggcgagtggagcgtaggactgcgaaccagcaatctcccgagaagcggcgagggggaggggaatgtctgtgaatcggttatccctcccacccccagcagaagtcggggaaatgggggtggaagggggaaaaagggagagaacaggagtggggttgaggaagggtaaggaggaaggtgagcttcctacagctgcgggggaaggtggagaaaattttcagggggacagctgagtggtagagctagcgagcttcagagaaatgttgacagacagatgcccagaaagtgaggatgccgggcatgggcactgcgtaccaggcacaggagatatatggaggcaggaaattggcacatcataagcatttgaccatcctgccctaaaacaaaacaaattgaacaacaacaacaacaaaagataatagcaaaagtggcacagtagtgagctcgcagggcccattcctatatagaaacacagaaaaataagcaaaagctgccagaattgacttcgtgggaactctgggaaacagtaagaaagttttacagcaaccaagtgagtgctgaaccaaggcaaaggtaactgaaacgcaatgatagagaagaggggcagggaagtgttgggtagacaaaggcgggtccctggtaagggccctcccctgggcctgtgcccactggacctaggtgaggacaggcactccttccttcacgcccaaatgttgcatatcccaagaccaccctgtcccgccacgcccccatcctttgcctatgaaaaccctgagaccctagcaggcagacacacaagcggctctatgtccagaggaactcatcggaggaactggacgtggagcggggcaccccagcggaagggagcacgccagtggaagagcacactgacagaccataggagtcagtctgttatattatcatagtataatattataaaattattataatacaataaaaatataaaaatataaataatgtaataaatatggataaaaataataattacatatttatatttatatgagaacactatgaataattttaagccaaaaaacaactcgatgttcatcactggatgagtagacgagcaatttccagtatattcatacaatggaatatgattcagccataaaatgaaatgaggtactgatacatgctgcagcaggaatgaacccccaaaacactacacttggtgaaagaagccagacacggaaggtcacatattgtatgatcccatttataagaaatattcagaataggtaaatccatagagacaaaaggagttttgtagttgccaggagttggaggcaagaagagtttaacaggtatgcttaatggggcctcctatgcagttgacgaaaatgttttgggctagataggagtgatggttgcataacattgtactaaatgccactgaattctactctttaaaatttttagttttatgttatgtggcgtgtaccctaaaaaaaaaaatagaggtgcagtgctccagcacgggatgaggcagcgtggacaggagcatctcccaacctcagtgaagtctgagccgcgtgcctgcaacaatcccactgtggcagagaaccgcagagttccttccggtttggcagcagtcattcgcaacctcacagccctctggaaccccagcctgggggtctcagaacgccgaggcggggactgggagccgagtcggattccgagactatgggccagggttggctggattcagttacctggctgaggcctggtgagcaaaatatcccaaacctcgcgtgatctggaaggggaagccggataaatacggatctccagatgtgccagtctcgagtctatcgatatgaggtccccctagagtttctattcatcattttaaccgcatttcatcgatcttgagacacggcttttgatattttatcacctcaagataaatagtgttagatgtctaatagcagcgtttttctaagagatacatgaaacaacagtgtcagaaacgatgctgtcttccatgcgatgaaattgttgtaataggtgctcaataaatgttgacaataaatgagtgaatgaatgaaaattattttatttttatttgagctttggttctgccatttgctagcagtgtgactcaagagaagccagtaacccccctgagcttccctagttcacaaaatgcttgtcatgaagtcgacagcttccggaggctgcgaggctcgcaagaaatgcccacatgaatgtgcgcttagggcgtgagtgctcactccagaaaactccaacacagtgaaaaggcagaagcggtgtttttcttttttacatttttataagaatatataaaaaatgatataaatggacatttacggtagtgggggaaggcatatatctacgttaaaaggcaggacatttttaaaagctctattttctaaatgaaaactacgaaagcggggtgggttgtggcgggggcagttgtggccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacgcatgcctgcttctacaaacccacaaatggtttccgatcatttctgaaacaaaatggatgctcatttattcatgtgctctggcttctgccttcctctctaatctcgttgcgtatgggctccagctcgccgttcggttctcccgaggcagcatttacacttgagagtctcaagattattttattcctgagggagcatttgcacttgaaagtctctttttacgtttattcctgaggcagcatttgcacttgagtttctttctcccgtagcttgcattagattctccgaccactctttagcttctcctcctattcacacttcatatttacccattgcattggttttataaactcgctctctgaaaatagattgttatcttccttaacgtctgtttcccaggtcgggcaagatagcttgggactgtaatcccagtactttaggaggaggaggggggatgatcgcttgagcccagataacatggtgagaccttcgtctctattaaacaaacaaacaaacccaggcgtcgtggcgtgcacctgtggtcccagctagtcgggaggctcaggtgggagaaccccttgagccagggagtttgaggctgcagtgagctgtgatcgcgccactgcactccaggttgggcaacagatcgactctgtctccaaatgtaaaccccatgagggcaagactcttgtttggtctcattcaccttggcgtgcccaccacctagaacagggctgatcacgcagtagaatctaaccatataattaattgtgcttgaagagggggtgttggggagtaagagaaggaagggaggagggaagaaatgaaagacttgtgtgtttggattaaatatattaggtttggttaagagtcgttcagtttattcatttgcttgtggcccaattcagtagttttactccctctcccacttggctcctcaggctttttgctcagccctggaaccgcgctgtaattggcagctccttctaaatcgggacccggatgctagctgtaactggagccgaagtctccttcttcacctcccgggacctggatgctagctgtaactggagggaattggcgggggggaggggaggaggggccgagtaaagaagaacttcgcgtctttaacttcgaaggtgattttgcgttctgtatttacagcatctccaagcagagggcttagagctaactcttcaccctgtcctccccagctcccctatggcccaaggagcccaatgcccccgttctgggccaaaataagatggatttcataatcttcaaggtcatgttttaccttaaatattcgtgttaattcccgtgtactgtttcatatatctattttgtttcaaaaaaaaatgttcctccccccagaaacaattgagtaatgttggcagtttcagcagacagctgtgggagtagggaactggggccatggaatgggggcggagggaggatgctttgagatcacaaaaaggaaaggcaagggcaaggaggaccataattctaccttcatcgctcagcgatctcttgcacaagtttaagagggaaaggagccaactccggtgcacagactgccagggtcagcgaagtcttggtcctgatgtccccagaaccccctggggcagctctggaaaactctaccgcataaagcggagggtcagattagctgaggagggtcagattagttgagttgtgcagaagagccgagatcgagagatctccagatgatgccacgcacaattgggtttggaaatcctgaggttggtccagccagcttggtatgcaaatgaggaaacagacctggtaagtggatgcaactggccctagtttggaggaagagggggcactagacctctagcctcttgagtcttcattgctccgcagtctaggccttgaactagcagagggtaggtgtttgggtggtggtatgctttgggaagtataatgtacaaaatgggctttcacgtgcgcaagtccatttcgggattatttcccatttgccgccctggcggggcagggcgatagggagactcaggccgtcccaccgattggcgcgtgagctgaggcaagaccggagactggtctcccgggctgaactttctgtgctggaaaatgaatgctctgagctttggaagctctcagggtacaaattctcagatcatcagtcctcacctgagggaccttccgcggcatctatgcgggcatggttactgcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcgtcgtgcacgggtcgggtgagagtggcggggtcggcgcagttgggctccgcgccgtggagcagcagcagctccgccactcgggcgctgcccatcatcatgacctgccagagagaacagaatggtcagagccagggtgggggccggcatgacggaaaggaagcttgtgtagagccccctcaccgccaagcagacccccacacaagccccaggtgtctaattacccctacatttgcttccagtttccaatttccttcttgagttctctatccattcttcagtacacaatgaattccattatatcctccgaacttctgcggagctgtcgtcacaggcagagagcactgtgaggcacgggcaaaatagcaaaggggcagggacagactgacttttactccaggctaacttcctgtatttcccctgagatacaactactgaaatttcttcctgaaattatgttaggcctggagatttttttttttttttttgttcactgctgtatatccaagcgcagaatgtggtaattgttaaaaagagaaaacttgtttgtttgttaaaacaaattctcacaaaacttttaagttacacttagcttctgggaatgttgaacttcaatttctttttcattatattagttttaaaattatatattgggatagtacagttgtatatatttatgtggtacaatatgaagttatgatctttgaacacaatggggaattattaagtcaagctaagtaacctatccatcatctcaaatatttgacatttttgtcaaatgagagcatttgggatttactatttagctatattcatcatgctatgaaacacatctcaaaaaaaacaatcaaacttattcctcccatcttaactgaggctttatatcttgattaccatctccccattcctcccaccccccagctctagtaaccaccattctactctttactgctaagaatgtaattgttttatatttcacagataagtgagaacatgtgatatttgtctttctgtgtttggcttatttcatttagcataatgctctccaattccaaaacttcaatttcttcaagtataaaataagaaggctagtttaattaaccctaaaattccttcctgtggtaggctgaataatgcccccccacccccaatgtctatgtcctaatcctcaaaaacttttaatacattaacttatgtggcaaaagaggctttgcagatgtgatttaattaatggtcttgagggagattatccagaattttcagggtgggcccaacataaccccaagtgtttttattagagggtcacagtcagagagaagatacaagaatggaagcacaggccacagagaaaatacagagaccatgagccaaggaatttgatggtcactagaagctggaaaagacaaggaaacagattgccccttagagtttccaaaaggaatgaaaccttgtggacccatttttgacttctgatctctagaactgtaaaataataattttgtgtttgttttagctaacacatttgtgataatttgtaacagcagcagtaggaaactaaaacacttcccaggtttatgatttgagagttcattaaacaagagatggtcacctctttggttcctaaatcatcttggaaacaaagccatttccagagaggaattttaaaatactgtctgcagtcatagcaaccttaaaatttgagtgctgcatggtggaagtag

SEQ ID NO: 428 - DNA, 8000 bp, Homo sapiens
  Locus number 40 genomic DNA region, cyclin-dependent kinase 4 inhibitor A (CDK4I), p16-INK4, p16-INK4a, multiple tumor suppressor 1 (MTS1)
ggatcccagccagttttggtgctggaggcccggccaaaggaagggctgctctcccgtcccgcgggctccgaggtcgccgcacccgggcgcgcctgggcctcgtcacccgcgctcgtgacgcgtgcttacaaaggaaacttttacaggtttcggtgggcagggccttttattgcccttctgctccacagcccccgtgcttaatcggttggttgggaggtttctttcgtccgtggttttggaaagtccccgcctccaaaccgcagtcccgcagtcagttctgcagcctcagggcctcgaacagccatgcttagaatccgtccttctttcctgctccatctacccttcccctctggcttcttttttttcactggagaaagcccacccgagtctctcagcctgcttcggaggttactgcggcctcctccacgggtagttctgggacccgggtctagtccgcggttccggagcaggtccctccctggagtcgtcaggcccagtatgcgtgtgctcagtgtgctcgggaaacacgcgtgggctttaacagcagatctccataaaagggtcccggagatagcctctgcctggcccgaggcccagtgcctcaaagcggacgcctttgcgctcccggaggtgctcacaccacagcggagcctgctggcgagtggagcgtaggactgcgaaccagcaatctcccgagaagcggcgagggggaggggaatgtctgtgaatcggttatccctcccacccccagcagaagtcggggaaatgggggtggaagggggaaaaagggagagaacaggagtggggttgaggaagggtaaggaggaaggtgagcttcctacagctgcgggggaaggtggagaaaattttcagggggacagctgagtggtagagctagcgagcttcagagaaatgttgacagacagatgcccagaaagtgaggatgccgggcatgggcactgcgtaccaggcacaggagatatatggaggcaggaaattggcacatcataagcatttgaccatcctgccctaaaacaaaacaaattgaacaacaacaacaacaaaagataatagcaaaagtggcacagtagtgagctcgcagggcccattcctatatagaaacacagaaaaataagcaaaagctgccagaattgacttcgtgggaactctgggaaacagtaagaaagttttacagcaaccaagtgagtgctgaaccaaggcaaaggtaactgaaacgcaatgatagagaagaggggcagggaagtgttgggtagacaaaggcgggtccctggtaagggccctcccctgggcctgtgcccactggacctaggtgaggacaggcactccttccttcacgcccaaatgttgcatatcccaagaccaccctgtcccgccacgcccccatcctttgcctatgaaaaccctgagaccctagcaggcagacacacaagcggctctatgtccagaggaactcatcggaggaactggacgtggagcggggcaccccagcggaagggagcacgccagtggaagagcacactgacagaccataggagtcagtctgttatattatcatagtataatattataaaattattataatacaataaaaatataaaaatataaataatgtaataaatatggataaaaataataattacatatttatatttatatgagaacactatgaataattttaagccaaaaaacaactcgatgttcatcactggatgagtagacgagcaatttccagtatattcatacaatggaatatgattcagccataaaatgaaatgaggtactgatacatgctgcagcaggaatgaacccccaaaacactacacttggtgaaagaagccagacacggaaggtcacatattgtatgatcccatttataagaaatattcagaataggtaaatccatagagacaaaaggagttttgtagttgccaggagttggaggcaagaagagtttaacaggtatgcttaatggggcctcctatgcagttgacgaaaatgttttgggctagataggagtgatggttgcataacattgtactaaatgccactgaattctactctttaaaatttttagttttatgttatgtggcgtgtaccctaaaaaaaaaaatagaggtgcagtgctccagcacgggatgaggcagcgtggacaggagcatctcccaacctcagtgaagtctgagccgcgtgcctgcaacaatcccactgtggcagagaaccgcagagttccttccggtttggcagcagtcattcgcaacctcacagccctctggaaccccagcctgggggtctcagaacgccgaggcggggactgggagccgagtcggattccgagactatgggccagggttggctggattcagttacctggctgaggcctggtgagcaaaatatcccaaacctcgcgtgatctggaaggggaagccggataaatacggatctccagatgtgccagtctcgagtctatcgatatgaggtccccctagagtttctattcatcattttaaccgcatttcatcgatcttgagacacggcttttgatattttatcacctcaagataaatagtgttagatgtctaatagcagcgtttttctaagagatacatgaaacaacagtgtcagaaacgatgctgtcttccatgcgatgaaattgttgtaataggtgctcaataaatgttgacaataaatgagtgaatgaatgaaaattattttatttttatttgagctttggttctgccatttgctagcagtgtgactcaagagaagccagtaacccccctgagcttccctagttcacaaaatgcttgtcatgaagtcgacagcttccggaggctgcgaggctcgcaagaaatgcccacatgaatgtgcgcttagggcgtgagtgctcactccagaaaactccaacacagtgaaaaggcagaagcggtgtttttcttttttacatttttataagaatatataaaaaatgatataaatggacatttacggtagtgggggaaggcatatatctacgttaaaaggcaggacatttttaaaagctctattttctaaatgaaaactacgaaagcggggtgggttgtggcgggggcagttgtggccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacgcatgcctgcttctacaaacccacaaatggtttccgatcatttctgaaacaaaatggatgctcatttattcatgtgctctggcttctgccttcctctctaatctcgttgcgtatgggctccagctcgccgttcggttctcccgaggcagcatttacacttgagagtctcaagattattttattcctgagggagcatttgcacttgaaagtctctttttacgtttattcctgaggcagcatttgcacttgagtttctttctcccgtagcttgcattagattctccgaccactctttagcttctcctcctattcacacttcatatttacccattgcattggttttataaactcgctctctgaaaatagattgttatcttccttaacgtctgtttcccaggtcgggcaagatagcttgggactgtaatcccagtactttaggaggaggaggggggatgatcgcttgagcccagataacatggtgagaccttcgtctctattaaacaaacaaacaaacccaggcgtcgtggcgtgcacctgtggtcccagctagtcgggaggctcaggtgggagaaccccttgagccagggagtttgaggctgcagtgagctgtgatcgcgccactgcactccaggttgggcaacagatcgactctgtctccaaatgtaaaccccatgagggcaagactcttgtttggtctcattcaccttggcgtgcccaccacctagaacagggctgatcacgcagtagaatctaaccatataattaattgtgcttgaagagggggtgttggggagtaagagaaggaagggaggagggaagaaatgaaagacttgtgtgtttggattaaatatattaggtttggttaagagtcgttcagtttattcatttgcttgtggcccaattcagtagttttactccctctcccacttggctcctcaggctttttgctcagccctggaaccgcgctgtaattggcagctccttctaaatcgggacccggatgctagctgtaactggagccgaagtctccttcttcacctcccgggacctggatgctagctgtaactggagggaattggcgggggggaggggaggaggggccgagtaaagaagaacttcgcgtctttaacttcgaaggtgattttgcgttctgtatttacagcatctccaagcagagggcttagagctaactcttcaccctgtcctccccagctcccctatggcccaaggagcccaatgcccccgttctgggccaaaataagatggatttcataatcttcaaggtcatgttttaccttaaatattcgtgttaattcccgtgtactgtttcatatatctattttgtttcaaaaaaaaatgttcctccccccagaaacaattgagtaatgttggcagtttcagcagacagctgtgggagtagggaactggggccatggaatgggggcggagggaggatgctttgagatcacaaaaaggaaaggcaagggcaaggaggaccataattctaccttcatcgctcagcgatctcttgcacaagtttaagagggaaaggagccaactccggtgcacagactgccagggtcagcgaagtcttggtcctgatgtccccagaaccccctggggcagctctggaaaactctaccgcataaagcggagggtcagattagctgaggagggtcagattagttgagttgtgcagaagagccgagatcgagagatctccagatgatgccacgcacaattgggtttggaaatcctgaggttggtccagccagcttggtatgcaaatgaggaaacagacctggtaagtggatgcaactggccctagtttggaggaagagggggcactagacctctagcctcttgagtcttcattgctccgcagtctaggccttgaactagcagagggtaggtgtttgggtggtggtatgctttgggaagtataatgtacaaaatgggctttcacgtgcgcaagtccatttcgggattatttcccatttgccgccctggcggggcagggcgatagggagactcaggccgtcccaccgattggcgcgtgagctgaggcaagaccggagactggtctcccgggctgaactttctgtgctggaaaatgaatgctctgagctttggaagctctcagggtacaaattctcagatcatcagtcctcacctgagggaccttccgcggcatctatgcgggcatggttactgcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcgtcgtgcacgggtcgggtgagagtggcggggtcggcgcagttgggctccgcgccgtggagcagcagcagctccgccactcgggcgctgcccatcatcatgacctgccagagagaacagaatggtcagagccagggtgggggccggcatgacggaaaggaagcttgtgtagagccccctcaccgccaagcagacccccacacaagccccaggtgtctaattacccctacatttgcttccagtttccaatttccttcttgagttctctatccattcttcagtacacaatgaattccattatatcctccgaacttctgcggagctgtcgtcacaggcagagagcactgtgaggcacgggcaaaatagcaaaggggcagggacagactgacttttactccaggctaacttcctgtatttcccctgagatacaactactgaaatttcttcctgaaattatgttaggcctggagatttttttttttttttttgttcactgctgtatatccaagcgcagaatgtggtaattgttaaaaagagaaaacttgtttgtttgttaaaacaaattctcacaaaacttttaagttacacttagcttctgggaatgttgaacttcaatttctttttcattatattagttttaaaattatatattgggatagtacagttgtatatatttatgtggtacaatatgaagttatgatctttgaacacaatggggaattattaagtcaagctaagtaacctatccatcatctcaaatatttgacatttttgtcaaatgagagcatttgggatttactatttagctatattcatcatgctatgaaacacatctcaaaaaaaacaatcaaacttattcctcccatcttaactgaggctttatatcttgattaccatctccccattcctcccaccccccagctctagtaaccaccattctactctttactgctaagaatgtaattgttttatatttcacagataagtgagaacatgtgatatttgtctttctgtgtttggcttatttcatttagcataatgctctccaattccaaaacttcaatttcttcaagtataaaataagaaggctagtttaattaaccctaaaattccttcctgtggtaggctgaataatgcccccccacccccaatgtctatgtcctaatcctcaaaaacttttaatacattaacttatgtggcaaaagaggctttgcagatgtgatttaattaatggtcttgagggagattatccagaattttcagggtgggcccaacataaccccaagtgtttttattagagggtcacagtcagagagaagatacaagaatggaagcacaggccacagagaaaatacagagaccatgagccaaggaatttgatggtcactagaagctggaaaagacaaggaaacagattgccccttagagtttccaaaaggaatgaaaccttgtggacccatttttgacttctgatctctagaactgtaaaataataattttgtgtttgttttagctaacacatttgtgataatttgtaacagcagcagtaggaaactaaaacacttcccaggtttatgatttgagagttcattaaacaagagatggtcacctctttggttcctaaatcatcttggaaacaaagccatttccagagaggaattttaaaatactgtctgcagtcatagcaaccttaaaatttgagtgctgcatggtggaagtagacaatttattttaggataactgttatttgttatattagtttgaggatggtggtgttaaagaggagttacttatttttaggtacatttcatactaaacacaaattgcataatttgcctaaatcaaggaattatactaaattatattatggttattaaatcctgtcctgagaaagtgaaactgactcagttttcaaagagacaaagagaaagtataagca

SEQ ID NO: 429 - DNA, 8000 bp, Homo sapiens
  Locus number 41 genomic DNA region, cyclin-dependent kinase 4 inhibitor A (CDK4I), p16-INK4, p16-INK4a, multiple tumor suppressor 1 (MTS1)
attttcttgtgttagaccattcttccccaaatcacattcttcacctgatatgtgattcaactccactcaagggaatcaacttcttgatgaaatataatcaactttgattaaataagtaactgcttcctattcatgttttagcacttttcacatacagatttaacatttccactcatgttttcctttgagtctctgggttgagggtagagttttatcttttgtgttgttacggttaagatgataacttccataattaatttttcaaaaaggcaatgataacagaatatactgtatgtttactctgtactgatttaaaacccccaagtcaatttagccttaagaaagcatactatttagtgtattttgtgttactctttgatatcctacttctaaataacttcttcacatttgcataaaaataactgaaggtcaccctccaaggtaggcattttgaatgtcgtaaggatgacagtaatgtttctgcctatcattcctttcatcacacagacacacacacacataattttttatactaaagaatttttagaaaattgttttggtcaaaactgttgattcagatattcagactgtgacaaccattctgaaggaattaaaaatccagttatcttcagtgattcctttggaaattattattctgggttattagatagatagactaataactttttttccagttttctaaagctaccttgatttcctgtcttagaaaacaggggttcacaaacactgcttaatatctctttaatgattatgaatactagaatagcttagaggtataccctaaaggccaccatatagatcttctgtacagatgtgaatttaaaagtatgcaaatttacactgattttacctaacaccttggaacataccaggagtctgaatacataaatatatttttattatgatatgtatatttttaaagtggagtttagaaatttctagctacactgaaaaattataatgaagtaggtatttactgtaaaaaactaatgtgctttcttaagggcatagtttaattaggcactataataactgacaaacgtacactgtgtaaaagtttacagtgactcttcacacatactattttatctacctcttattacgggactaccatagggtctcaggtttacagatgagaacatgaaagcactgagagtttctcatacttcattctggtaccatgacagctaataagcaaaagaaatagaatctgctcacaggtcatgtgaatgctaaagaaagtaatctttcaactgcacgcttcaagtggttcctgtgctggtgaataggtatcccacttattgcttttaaattaaggtaggaataagtaatttatatgtacagtcatatgagaatttttcactggttttattttggtcaaaaaataaatttttgaaagatgttaacctcctttcaaccaataaatatttactgtgacttatacggctgatgcttgagtatagtagaggcccaaaggggttaagcgactttcaaaataatagttaactaaaagagatggaactgaaaccatatacatatttatagcactccatgggcaaccaagttcaactatatatgaattactagtcaatgacttttggtaggccatgcaacctatctgagcctcagtctccagatctacaaaatgaaaaaatgaaacattgaaaacataaggatattgtgataattaaattagataatggaagttgaagtgtcctattattgttaagctcctcctaattgtttttgaagaaaacaataactttaccatgtgatttaggaagaaagtttcaataagcttttaaaaattaaatgttaaatataatatattcaacttcaactattcagcatgtaaattgcatggagtaaaattcaaagtgtccgatgttggacatttaacaattagatgttcaactgggggagtcattgttctctagacagctgctgtttctttaaattgggtgagagagttatacaattgctgagtcagatgatctggcagcctgaaagagaatgagagcaagaaaatggtggcactcgagaaaagaaagcaaaacaagctttttcctaatacatcagcaaagtcactggtgtaatattagacaaattttagcttaaaagcagaaaaatgatcatttgaaaggcatgatattttagtttttcttataattgttactttttagcttacatttttcatctatatttccccccccatcactgtgcttttacagagacataaagacccatcattttgtccataaatgctttattctgttatggctacattttcctgcaatcttgccctgatcttagataagcataagttaaacctgtgaaacacttgtgctttgatttttcttttttacataattttaggttgtcatgtttattacgagcctggtctggatcataaaatgaaagaaaccccttattacaacacacacacacacacacacacacacacacacacacagagagagagagagagagagagagatccattcatcctgcacgaacagaaagaagtgtatatagtgttttaaaaagacaacgtatcttatatagcttatgtggaaattttctgtctggttctgtaagctttaaaacacaaatatatcttgttatatttttttctctcaaactatgttctgactgtaaaaatgtggtatctacaagacattcttttccaattcatacaaagggtcacataataataaagggtctccttcatttggtgaaataactcctccactgattactcagactctcctccctgggatccagtaaactgactctaaacttaaaatcttacctaaaatcctggacctcaattcaaagataaagaagcagaaataaggtttaaaaagtaaaattggtcatatttgtcaaattgtgtcccaatgggccacttgtattagtatctccttcaagtgtttatttaaaatgcagatttctgggacccacagcaaatctgaatcaaattttctgaacgtgaaccccagaaatatgtatttttaaaggcagcccaggtaataatgctgttgttaacctttgccatacttttaaaatttctagttactcacataattcaattaagaaagcagaggcttttttatttacgttaccttgattgtacgattttattagtttcaatttgcttaagagattacatgtctttgttcatgtaattctgaacctctataaaacttttctctcttaaaaaaatcctactgccttcacaaccatttaaataatttatgatattttattttgaaggtgaaagagaaaactgagaaatagttgaattaaaaaatcctttgtgataacatgtttatattttcatgaacaaagccaataagtcataaaaattaaaaatcaacatactattttttgaaaggacctctgatgctttgggaatttcaatcctgtagttgatggctttcacttttttttcccttttattacttctttttgattgtagagttctgcccaaatgaaaccatcattccagggctcatgaattaaatgaatgcactgagagacactgacaagcactgagaatttcttcaaccaccctttttaaaaaacaaatgctaattggacataaatatgagaacaatagacattggggactactagatggaggagaaagggaatgagcgagggctgaaatactacctactgtgggtactgtgctcactacttgagtgacagattcagtcgtactcgaaacctcagcatggtgcaatatacctttgtaattaacctgcacatgtgccctctcctcctaaataaaagttgaaaaaaaatctacgaggcactatatttttaaaaataccactatgtacaaggcactgtgctatatctggaactacaaatattagttaaatagtccaagattcagtgggttcagagactctaagtatttgccattccctttagatggaaacgttctttggtccaccaagccctatcgttctgctctttggaaattctccctcactttcttcataatgccgtccttgactaactctcctctagcaatactattggttttgtatgtgatttaaaatcattcctgtaatttcttctgtttatatggcttcgtacaagagattcacattcaacaaatagaaaaaaaacgctattgacatttggtagcttcgacaattgtaaacacatgtgggtttgctgaatacacattaaaatagcatgaattaggatatggtaaatctgttgcggtcccaagttggtgggtttttctaggaagagtcagaccctttaaaaggaccttttatcatctaccaaacaaatccttcatttattaattcccaaggttttctccatcggttggcttactgtcatggaaattgatcttgttttaatagctacttacttttttttattctaatcaatgatttcatttgaaaagaaaattttcaaacatggggaaagctgcaatataagaagaaaacaatggagagacatcgtcactggaaaaatactacgggccactctctataccatcctgcacccccagatggagaaactgagggaagtcgtggcctttcaacactcttgggtctccatctggcttggaagggaacgaaatggctgtcaagagtctcagaagcgcactttccccgtggttcctccgggtaaccctgactcacttttcatctacccatcccctccaaaacaaggcctagccagttccaagctggagaggtgacccagagttgccttctgtcatgtcctgcctttcgtctcgagtccactaaccccactcagactctgtctgctcccacccccaccgcggccagtgaaatcccaatcgtcttccacgtggaaccccaggtccgcagttatgataacggatcacatcgctcctgcggaaagtgcgcgcggtggagtgataattggacctagcgtctaaattcttgttggaggacctcgttccagctgccagttaagcctctgggatccgcagcgtctctaggaattgagagagtggggaagttaggatccaggaggaggatggtgggggctgaggagtggaggagcagcgtgcatctcatctcttgtcgccgggcgggcgctctttcgggtccagggcccttgcacccccagcgtggctccggaggcggcgagacctgcctgaaattgattggaggggactagagtgtgcttgtggggtggggtagtgggggcggagagaagagatcccaagaagggcgccaagtgctgtgaccagaggcctaacacgaggcaccttggaaacaggtatagctacggatttatgggttttaaaatggaacgtcttggtgaatggacatagcgtgcatttcacagtctgacgtcacagccctcgcaggttttcccagaccttaaagccacgttctcgtgtatgacacttaaacaactcagtttccttgtctttcctccctccctacccatctaagggtagagaagctcttagttcatccactgtgtaggactgttaccgtgtgtcaaaggctttggaaatgtatattttactgatgatggtcatagcactttggaaaactcaaaagtgaaacgaagaaaataaatatcaccaaactttttcccaacccctctcatcctgcggaaaccattataactaatttggtgagagagagagagagagagagagagagagagagagagagaaactgtttactgtttggaatcttgctttaaaaaaacctgactttataatgcaatcatttaacagtctatgaaatattcttcagatacctgatgatccagaatgtaactgtaccataatttaacactttattgctagaattttatgcagtttttgatttcttgctactacttatccatctgtattaatctttgtcagaacctttctttccttaggatgatgcctgaatataaaatagctgaatgaaagtggatgggttcattttaaaatacaaaattgtttttcttgatggtgaagtgtttaagaggtggattaatctcattgggcaacaaatagagaagatattagtagttaggtatatgagaatcagaattcagataatttgtcttaaaaattcatattcaatgtaaaaattttatatttagaaaatgaaactgtacccattgtttatataacttaaactgccaaaataaagcaccacaaaaactttttatcacgttggtttttgtatcaggctgggctttgcagcagatggaggagctagggcaagcttgtccaacctgtgggcccgagggtcacatgcagcccaggatggttttgaatgctgcccaacacaaattcatacactttcttaaagtatcatgagtttttttttttttttaagctcatcagctattgttagtgttagtgtatttaatgtgtgtcccaagacaattcttcttcttcctatgtggcccagggaaggtaaaagattgaacacccctggcctacagtgttctactatgaagtttcagttttagttcggcctagaatgttttagtacagaaggcaagtgagattttctctgtttctccaaggacttttgaaaaagtgtaaaagcactgggcccactgttgaaccttgctataaaaaagtatttttgataccatttgtatcactttagtaataggagtttttcatatgttgggaaaatggtttagcttaactctatcatggtagttgatagtgatgaactaacgtggaataatagatctgtaaaccatcatagacggtaataggctatgttgttgctaccttaggatcataatggactttctaaaattcaagagtactcaaagaagtaaaatgaatataagtcttgatttctgaaagggctatggttcacttggaacacaatacaaactgtgaatcatgtacacatggggaataatggtttatactaactgcacagtgcttaccttgagaggactctgtgctattaaagaaaaaaataacctgagccttctgaagtagctataaacaaatgaatatttaacttcataataaaaatatgactattttgtaaatgcaccaaggtagaagtaacaaatcaactatggcaatttttcaggtttctgtggttaagaaactggtaacgtggaattttagtatatgtatttccaatcatataaaaataaaaagtcataataaacatatttgcagaaacttaaaaaaagttaaaataacatcttatttgcaatgatattaaataattcatacaagtaatttttagcacttgtgcctctcaaggaattgtatgaatcctaacataattagtatccatatatattcccaaatcaatatagccatgggcataaaatatattaatgtgaaatatataattacatatcattataattaacaccgctagattttatattatgtatatcattttacatatgaaattggaaaattgcatatatttcaagacattctatccaagctgtgttctatcttgagaaacttcctgaagattgcgcttttcacatacgtcctgaaaattgatttatacctaaataacaaaaaatgatctatttcaatgaacctatcatttaaatatttttgcatttcatgcatatacattaacatactataaaatattttctctaacttaaaatcaccacaatgttatgttttataggcctaaactaaaaaatacataattatggcatttatatacattgacatgttctactttgttactacagattttcagaggcaacttaataatttaaacaaaatgattttatatagaataatattaactagagtaataaatatttttatatagacaataatattaagaactatattcatacagttaccggtcacagtggctaaacttttgctgatacggataaaccactgttaaaaaaaacaacaaccagggtcttgtcaatgtttcaaaatgaattaaaatcaaatccagcaacaggccctgaaatcctttataagctcctttgactaaatt

SEQ ID NO: 430 - DNA, 8000 bp, Homo sapiens
  Locus number 42 genomic DNA region, Feature name ha1p_12601_l50
taaaagcaggtggtcattgacttcaaggggacgagatcgccctccccactgcctctccccatacagacgctcacagaatagacggggaagcaactatgagagaaacagaagcaatcagaactccagctcagacgacctcaggagttttaccaacaggatgattcaggaccacacacaaaaaatggcagggtgccatttcccccgaatctctcccgcataagatggaaacaacaacttgaggtggcaactgagcaattagttactgatcatttctatgacaattctctgaaggctccaaaggcctcctatcttgaaacccaggtcatctctgcattgctattattgaaaatctttatccagttgctctttgaagccactacttggagcagtaatgttgggaccaacacacaccttttatgatattaaaccagaaaatcagcatcatcattaagacacagagactgttcccaagagggaaagaaaatatatctcctaatcaggccagtagctgaaacactgcaatataacctgtagcttggaatcacggtgacaagcacttaaagctgcatttaatgtcttcattgtaacttcatcaaagtttggcacacaaattctacctttattctaagcataccctttttctaagtctcatgaatcccaaacttaaaccctcttcagagttttttttccccagaattatgtatcttctgggattacctaatcacagtttcacttgagcctgggtccaattttaagaaaatctccctcccttcacgcttatatccactcccctgaccttttctgaaaaatcaagagacttaagatgtggaggcggaaacttactgaaatagccaaatgcttttctatagcaatgaaagctcagtcatttgggacatgatttaatcttgagcttcagagcagaatttgaaaagcaaattaaatccttttgtaagaaaataatttcatcttaacccaatcttttaaaaaatcattacctagaacagtaaaccaaatagtctaatatgaatgttcttatcatgtgaggaaaaaaatgagtagtctttaacactagttagagcaagtctatagaacacgtgtccagaagcatgtagttcccttgctttctgtctttatttcatcctcagtatcactactgctttgggcagaattctttcaaaatttaatttaaagcagcacagtgggggaatcaaaaataaatatgttgactattaaaaatatagagattggtaaaaaaaatgatgatgatgaattctcaatcctacaaacttctgtaaacgcaaaaaccaagaggaagataataaatctttaataattgattgatattcagaatatcttgatctaattaatttaaagcatggcctacctagccaggtaaaggacggcacagctaggcttatttcttcatttgacacatactgaaagttaataatgaagctaggtgcttgggaaatttctgagaccccatccttccagcatgcaataattaagtcaaagaggccaacagtgtgtatatcagaacaaggtgaagggtaaagcagaccagaaaaaaatattaaaaaccaaaccatctcctcctttctttttttccttctgttttcctttcagactgggttgattttagttccctccaagacttcaagtcattgatctaacaaagatcattgtttaaattaatagcaacacaaactcccacaaagtgatctcttcttatgctctaggttgagtactttggtttatctagaggttgtgtgttacgccgctgaccacctttcaccttttagaatcggcacctgcaattctcaaatgctctggatctaattgccaaccttttgagctcaaaacttcggcaactccttcatgttgggttgtcaaccctttgctttccctcccctgagaaattcgtatgaccttgccttaaaacttttaaagaatacattttaaaatctatattcctgctaaagaaaacagtgagtcattaaaataccaccagataaaaaaaaaaggtttgatttttagttcaggtcggtaatggcctgtaagtaccttgaagatggtatcttcctatcacttatgccttgggacagtacccaagagtggctgaacttttacctaattaaaaaatgagtcatttatttgaaaaattccacttccatttattttatctgatttcttaaatatccggtcaactgctaatttgtcagatgtcataattcgtcagtcctacccttttctacaggctgaatttttaatttgaaacaactacacctctaccgagtgttactttcagacgtaaattactgcaggaagacccccctctgccttggttaacacttaaatgagatgcctcctgtccaggacgcttcctcagtctcactgtaataatctgagtctaaagtcacctgtgcttctgggcggtccaatcatgtattttcaagagtgaaaaaaaaaaatcagtttcttttatgggaaaagattcatcactacaggaaacacgatgggactgactgtatatgattatctgccttcccagaggttgacccttttaaaaccgttttataaaccctttatttcccactaaatataccaagagacagaagatgagtgatagcatgagggataagagctaaagagagaagaataagaaaaaaatatacacttcaaaaattgggacccaaatgtaagattaagggacaatagttagaaggactaccaaaaaccaccttacctttccttgttaagtttttggagccgcccacttcagaaattaacaccattcacagcccaggagcaacttaacacagctaggaagtcacctacaacatcttctcgtccgccttctttttaatgtaaaaccaaaataaggagtgtccagcgactccccaccgcgccgcttaaagcaacagagcgttttaggcttaactcccaggctctgggaattccagtgggtcagaattgcttaaccttggagacttgcagagagaaagtctccaggaggaccgctccccaaaccctggtttctctctatcccaagctgcacattccacagtggaaagcgggagcggcgacccgaaggcagcgaagttctctcgggctcagctcccgaggccgggagcgcgcggcggttccacccgcagagcggcgccgcgtcccggctgcgtggggcgctgcgcacgggagcgctcagcgtctagtctgcgggcccttcccggttccctccctctctcctcccgccgcccgccccctgccgaggccatccgcctcacagtagcaaggttgtctctcgtctactcccttcccttaaactcaccaaaccagatttttactcccaacaccggcaacttcccgtaaatctgccctgaaattttatcctgctggctgagcctcccctggctaaaggccagtgccacattcctgttgttttttaggagcgcagatacctttgctgaaggttcaaagaaaatcggccttgatggcagagattgggggacttgaccagacggacttctctccccgccccaaaagtcacatgcctttcagacacccagaagtggcacctgctccacctgggggcatctgtccgagtcagacgctcggcccccttcgggctgctccgagaaacccagccagaaccacgttggagaaattaggaacctgctgctgaatttcaagccgatcggaaccgccccgctccccttcttccccccataaacaagtcgctggacgaggtgggatctctgcgacccccgcgtgcccggggagagctcccggggcgagctcccggggcgtccttacctggggccgagcatggcttggccgcgcgcaggcaggagcgtcacgcggacggggccctgacctttgccggggccttcgcagcagggcctggggcctgggcgctgctcgttcagaagtggctcattttagtgcgctctgacctagagttacggagggtttctagaaagggaacaaaaaaacactgcatttagaaacagcagccaagccctcgcttcaccttgcctgctctctggggagttggctcgaacccccaccccatcccaattcccaagaaacccagatgtccgcaatccgcgccccaccccctccgccttacctgtttatacaagagttaaggagcctcccgcatttcagtggagcgctaagcctgtttgtaggcgcggaatgggccaacaggaatcgaattctgtgactaaacaaactagaagaggaagcaggcaccaccaggaacctaaaacagagttgtgatttcgggttgcagtgtcattcagctgaggggaaagaaaaaaataccgggctactttagtgaaagaatgttccaaaaatggttctttgctggttgagttaacacatgcaaagagcttagaacggtgcctagcacacagtgttagctgccgttattgttgttgttattcttcttattattatttacattatggcttttttctgaagaagagtgtgtggtcagagttagacatgggctgtagcaccagcattgccactcaccagctgtgaggccatgagcaagatatttaatctctcccagcctcagtttctggaagattctaacgatgggatttttacaaacagtttatattcattgctgacagtcttgaatacaatgggaaataaagtccctgtaaagggtagccaactgaatttcatctcacttaaaagttacaagattgacaacagaaatggagataaatttgcctgcattccatgaagctcactaacgggaaggaaattcagggcccagcaatcacccatctgctatgcttaattctcatttgtattttggcacttgacctggtgtcttaccctgggatagttacttatcccagactgggccggacaaataatgacccttgccgtttgaaaagcagtatgaaagagagggaaatgattttgaaactcctcataaatattaaaaagtgattattgaaggctaaaatgttatcagtgcctccaccctttatcctccatttaacttcacatttaaagaaagaaatcataatccctttccattagtgaggccctttctactttatggagcactttcacccttcttactttatgtgatccttacaaaatgatcctatgagctattttgtccccattttgcagatgaagacactgagatcacacaggttaagtgtaagtccaaggtggtgaggccaggactggttctcagttctagttaatttttttttaagttgaaaaatcaaactggatttattaaaatatatataaataaccctcatttttctttatttcatcagtattggaaagttaagtgaaaattaattaaaaagtagtagtcctaagagagagaaacaaaggctgaaggggtatcaagaaaaccataaatttaaaaagcagcatttgccacctttgggaaaaatgattccttaaaaccagcaaagcattctggaacattttaaatccttctgatcttttatcttctcatgaggcaaaatttaacccagacaaattcaacatttcctgtgttttaggttcattctttgtcgataccagccagcatgtactgtgaacagcaggcagtgggaactctcttagctaagttccctcaccagacctaagggttgatgctgccaggcacaaacaacggctccacccccttaagacaactaaaaaacccagctccatattagcctgaaattttcttttcttttccagaagtatctggattatggcctcaaaaaaggctcgctgtcacagactgtctgagctgaaggattctagaggggacattctcgctgggcacggtggctcacgcctgtaatccccacactttgggaggtcgaggcaggcagataacctgaggtcaggagttccagatgagcctggccaacgtggcgaaaccccgtctctactaaaaatacaaaaattggctgggcatggtggcaggcacctgtaattctagccactcgggaggctgaggcgggagaatggcttgaacccgggaggtgaagtttgcagggagccgagatcgcgccactgcactccggcctgggcgaaagagcaagactccgtctcaaaaaaaaaaataaacacataaataaatttaaaaaatgataaaaataaaagaaatttgaaagtgtggaggtcagtgactccaggtgaactggaactggagtcagggaaaactcctgcttgaggaggctcaggttccacttcaggaagtgagtcctcatctcaaagagggtcagttaccctttttcagatgttgcctgctccttcttcagttttgcccactgacacctatgaaatgggtatatcctttctttctttttttgcactccatatccgctggagaaatgggtataattcttgttcctatttctcactgccctccccgggaacatgacaaaaataaaacagatttttctaagtggcaggctatagcaaaacaaatgtgaacttttattatttcttttttgtggctaaccttggcgcctgttttattattattataattattttaattcttaggcccactccattttcctggggcattttagttttctagacccttgtcttttactttctgttttcttcttttccttctgcctatgaggcaatgttccggagtgagtgcaaacagcatgaaaattagtttccaatagatttgagtttgaatctcaatttcttctctgagctatgtgatgttggacaaattgcttaatcgctttgagttttagtgtcttcatttataaattaataacagctatctttctggatttctttttgtttgttttttccgagatggagtctcactctattgcccaggcaggagtgcaatggcacaatctcggttcactgcaacctctgcctcccaggttcaagtgattctcctgcctcagtctcccgagtagctgggattacaggcacgcagcaccacgcccagctaatttttgtatttttttgttagtagagagggggtttcaccatgttggtcaggctggtcttgaactcctgacctcgtgatccgcctgcctcagcctcccaaagtgctgggattacaggcgtgagccaccacgcctggcctttttttttttttttttttttttttgtgacagagtctcgcccttgttggccaggctggagtgcaatggtgcgattttggctagctcgaacctccaccttccaggttcaagcgattatcccaagtagtggggattacaggcatgcaccaccatgcccagctagttttgtatttttagtagagacagggtctcaccatgttggccagactggtttcgaacccctgacctcagatgatccacccgcctcagcctcccaaagtgctggaattacaggcgtgagccactgcacctggccatctctctggatttctacaagagttaaatgaaagctaaaatctcagcatggtccttggcacatagaagttactgaagaaatggtatttccttttgaatctggaaagaaacctgctccacagctcacaaagaattgtctttcccatgcttaagtcctagatcaaataacactatctaagacaccctcatcaagagaggtaagccacaatagaaaaataagcagtcatgtgcataccatttgcactcatgggcatagcatgtacgtagcatttccaatgatagatttattatcacctttgatcatcacaactgtgagagttaaatatggataaggcggggctgggcacagtggctcacacctgtaatcccagcactttaggaggccgaggaaggtggatcacctgaggtcagaagttcaagaccaggctggtcaacatggtgaaaccctgtctctactaaatacacaaaaattagccgtgtgtggtggcggctgcctgtaatcccagctactctggaggctgagacaggagaatcacttgaaccctggaagcagaggttgcagtgagccgagatcgcaccgttgcactccggcctgggcaacaa

SEQ ID NO: 431 - DNA, 8000 bp, Homo sapiens
  Locus number 43 genomic DNA region, ubiquitin ligase LNX, Numb-binding protein 1, ligand of Numb-protein X 1
ccagaccctattttctccactttaagtgaggaattcaaatatagaaaggaagtcttagccaaggtcttggagacaaggagacagtgacaggtgaagccaggaaatcaccgctccaggaagacccgctgtttactcacatcacagaagcccactccccacaggtttatgaaagaccaggcatttccactggcagccactctaccctggaactccaagagaaacaacacaatctttgttaacaggttttcctcctctgcctttgggagccttttgggaaatctttttttgctcagtctttggccctcaacgtactaccgtttccatcattattacatccagatagtagcatgacctaagatgtctaactgtaagcaatataaaaatgtttaaaataatataacaatagttaacactcactgaacatttaaaatatgccaggcactttccatgtaattatttcaattattcctcccaacagctctgagtctgggaagtatttcatttcccagctgatgaaaccaaagcaaagaaatattaaggaacttatttaggctagcaactacatggtagaactgggtctgatacacagacctgtctgatactatcaactatgccttcctttcaatatttacaagtaacactgtggcaggtaccattccaagcactttacacatttcaacccatttcatcttcatgataaccctattacacagctgatgagagcagcttaaagaatctgtcccaggtcacacaggtagcacatggtagatctgggtttcaaaaacccaggtaggcagcctgatgccagagaccagaccactattctaaagcagtagcattgccccacctagaatggaatgaataagattgatattttctagtgaggcactacccagtccccccagtcagtctgacctacccacctggacatgcagcccaccttgcttcagttgtaaggatggagggggcctgtgaagtacaccattttagcgtcctttggggaaaaatgtagctaaggaaactgacatgcaggggggttgaggttctcccttagggctccgtaggcaagctagtagaacagtagaacccactgacctcaatccactaatcccttactcttgaatgatgaaaatttgtggtatccctgaagggcgagacccagagaagtgaccagggccctgggcacacaactgctcatatgcaatgactcaaggtcacccaagggcacagggtattgcatgacaaggccaatcacatccaatgggtcatgaacctccttctatggtacaatgaggctccaaaccaggggcttcctcctgccagaggctcggcatgaaccctcactctggttagggagaagggtgtttatctgtgagactggaggagaccaaacacccagtctgccctggagatagcacgactgacagcaaaaagaactctctgccaagtcagattacagcaatgacaactggacatttcccccgaaaggcccatggagaatcacattttgtgggtctgttgcaggatgagagccttagagtgggaaaaggaagaaatcacagccagccagcaactcctaaaagctttgcctgtgaggctagcggagacaaatctgcccaccttgtttgatgacattgtttaagaattctcctgcctgttttctttttccaaactgttaacattgcagttaattacctacaattaattacaataacaagaactatcaaggttcctacaactgcaaccacatatgatctttatcttgatagagtcagactctctcctccaagcaacctaggaaaattccttccaaaggaagaacctagcctcagtttagcaccagttaacaccaggcattggtcgctggatgctaacatatattagctacctcatttacttctcacaaccacattagatcatggggattattatctcccatcttaccgatgaagaaactgaaagtcagagaagtaacttgctcaaggatataaatgaaggagattgcacatttttccatcaggcctatgtccacttgaaccaatgggtggagttaccacaggaactctggacaggacttgtgtgtaaattacccaacagaccaactgcattctagtcaatctgactctgaattccagtctttgtcacttcttttctttcttctacctgggggtacagtgtctacagctttgttcctttagtactcagacatgctgacatacagtgatgaaattatttatttaatcataaattaactactgtgaaaagcactaatcaaccatggtaaaccagaggcaatgtaatcttgaggagaggtttagatgcacttttatcagaagatccaagctttgaatcaagtgagaaccttagtaagagacaagtggtggccaaacccccccccttaaactcacaagcttggggaaaataataaacaaaggtcagttaaggaagaacaatagggacctccaaacagtaagacagaaattagcaacaagaactgggcagattcttagtggtgaggaacgactgtctgtctaaggcaaaaatgatctcagcttgtttcaattcataccttgggagaatttacatgcattttgtatttctgggtggatgaacaggagcataattcctaacagattattcccttgcaaacatctgctaacttaaatctcagaaaaacagctgatgttggaatctagaatgaagtgtctcgcagatttatttctttttccagtttttccagctcatcccagcaggcagctgggcttaaaaatggtttcctttctctgacaacaatattggctaaagagtttgactattgggctgtcaagatacaggctgtgtgatcaggattaagaaaacaaaaatggatcctagaggtaaaattactttaaaagccaggtcctggcagaacaacttcctcggtatatttgctattaaaagaaaaagagacagaaaaagccaaagaggtccaaaaaattaaaaatcagacctgaagtcacattcttgcagcaatgagggaattaattcttactgtaaccaaaggtcagcaggcagccagtccaggtctaaatgtaaacaaattctaaatgcacactgcaaagtcgtatttaaaagagtgttcaacaaagagcaaagaaaatggtagactttttcagagaagagaggaaaactggaacgcacagcttctgaatagggcaacagaatttgccctgaggaacaggttttcagggggaaagaaaaaaaaactagggacacttcacaggtttagatcaaaatacagggaggaagaaaaggaaaaataagaactctgaatccagtctgcactggcctcctagcccccgttaaacgggctgaacagatctgcaccttcgcgctaagtttcaaaacaaaagccttcactctacttctctttaggttgttgttgttgttttaatcagatcaagtacgaggacaagcacaggctggattaatgatcagagaaacaaaaaggattaaatatctggcctgggagaagtttattgtgcaactagaatgtcaaagtcatctctctactcttctgtctcaaaaaagcttctccctctggggcaaacactagcgacaagccgttcagcttgtattttttcattcaaattccgtgttcagatccctcaggggccagtggtctaaatgccaagagagaaaaatggagggtttcaactcacctcttcaagcgactgtctggggctctccaagcagcagcaggcaggcagctctcattccttgtgggtgaaccgagcagctccttgggccgccggagttgtgaccagcctcaacttcggtgaacaggtgcctggaggaaggaggacggcattggtcgctccagaccaggaaatgggtgacatcacggaagccccgacagataaagcattgctgagaccttagggattgaaagagtcaggaggccccgcccacctgtcatttacctgaatacctgcaagcaggtaggtggcgtctctttgtggacaaataaatcagttagagcaatttgccaggtggaatttactttctttcctgagcacagcacgtgtccagccccgtgttcagatctgaagtcaaatgcctggttgtttcccaggccctcccctttccccatatctgcccacaaaggagttaaaagggaagtttaaacaccaaaatgagacagtaatttagcagacacaaaaaggaagagtgtgaagccgaacttcttagaaatatctgaggtgccttttcgaaccgcatccatttgaacaccaagtgtttctctaattccaataaaatgacaaatttaagttgacatttccaattcatcttttaaacaatttgaaataggatacctgtcagcagtttcaaagtggttttcaaacacttttgcgctaccccctcccccgcccagcatttttaattccatattcaggaatttgcaaaacttcagtcattcctatctcggctggcttggcagttagagtcatacggcagttacagtgcactgcaggcctgcaattaggagcaatttaaatgattcagattggaatggtagtactgtcattaggcgatgttgtctgctgatatagccaggaaagagacgtcagagttatttctgtcccaagcgtggtgtgtgaccctggacaagtcactggttgcttcaccttttccagcaggaaaggaggcgtaaactcatccagcaccagagcaggcagctgggaggtatcccaggactgttaaactctctggcatcttcccaggagggctgtaaacatctcccatcatcccattgaaacgctgcgtatttttaccacctgcatccagcatccctggaactcattacctgaggaaactgtggattccccgtcccggaagatggcctgcctgcccagagagaattttttttccccttcaggaaaataaatgttgacattcctattttcctcctacttttgcctccctcgtcttcttctttccctcctcctgattttgggaatgcttttgttccaccggttttaatattggactacctagaggttttggggtttggtttgggggagggtggaggaagaaggaaaaatgggagagggaagaaaaggaagtccggattcccacagcctgggcctcagctggctgcagtcagtcaatagctcgcaaagcaagggggaggagaaggaagagaaattgtagtcgagggcggggtctgggggccggctctggtgctcgacctcaggggagctggctcctgtccccgatccgccccagacaggtctaagctacctctttgcacctgggaactctgtgccttttgagagttgaaggcttaaaacaacaacaaccaccacaacaaaactattcacctttttatccaatagaaactaaggtaggtgtggctattcctttattatttaaaagaaaaaaagggaggtaacaaaaccttttacactcaggtgtttcaggaaaaggtttcacgccactagtttgataattgagaaacatcactcacacaaaggcccccctcttcacgcggacagggtgtcccctgggcaagggggaggggagggagagcccgccaacctgatgaatcatctagaaggccacgccttcagcggtcttgcctttggcgaagggcaggatccaacttgggaggggatcacaggcttcggttcaaggccttgggtgggcaggggaagggtgtaggtgaaatgaattcgcataaagcttcaccgaacagcctggagatcgtgaggtttcacttgccatgttcacatacacacagtcatctacatatgtggtgtgatgaattgttgtaaaacagaaagaaaatagagaaataagagttaatccaggagtggagctaactcccaggtatagtgtataaaggaagagaaaaaactacacaattagccttctcaggtgagatctttcttggtactcctggatttcgaataatatgcaggggttaaaaaaaataatatgggctttttttttgggccattagggctgttacattatcatggaaattatatttctaaactactagaaaaaaatgtaatcataaaaatgaacattgtgtttaacaggtgctacttattgttctgagcactttatacaagaaccctgtgtcaggtatcattgctatttgcattctacagctgggaaaaccaagacatagtgaatctgagaaactgcctaaggacaagctcatcggcaagcggcagagcagtttttaatcaaggcccactttttaaccactggaaagaaaagagggaaggttctgatttcatgctcactgggacacttcctggacacattcagcttcttacccattattcagaaggagaagtagaaacctgtagaagtagccctggggagggtagtttctgataaaggatgtctccatttggaaattaattagtaatctggtctatatgctgaaagtgtgtgtataatatatatatatatatgtatatataaatatgtatatattcataaattcatgcatatatttatgagaaatcataccaggaaatccatcgcccctgggtgcacacttgaaatcatcttttgagagcttatcaaatcaaccccaagatggaaggccagcttgagggacccctcaagaatgaccagttgtaactctctatgacatcttttatggtcatttttctctgtaacttctgcggcctatcactttaaaatctgaaaatttaatccgagtggccataagaacatggaactgcatacatttggaaaatatgagacaatgaaaaattaagtttcattataaaccactaccaggaagaatggtttagactaggcttggcaaatcctggacatatagtgctccattcccccctcccataccattctcactgtcattgctaaagaccatgacacttttcaactcagaaggaactttggaatcttgaagatattactccaggcacactagcagttggttttaccccccaagatcaaacccttttcttttactttcttactttcttttctttctttcttttttaatttttttttttagagacaactctccctttgtcatccaagctatagtgcagtggtgccatcatggctcactgcagccccaacctcctgggctcaagtgatcctcccacctcagcctcccaagtagctgggaccacaggcacgtgccaccatgccctgctagtttttaaattttttctagagatgaggtctcactatggtgcccaggctgttctcaaactcctgacctcaagtgatcctcccacctcggcctcccaaagtgctgggattacaggtgcgagccacttggtccccttttctatctctagttggacagtaagtgagacagagaagagggctgatcaggaagcaaaaatattggtgttggctggtgccattggggaatatttcatgaagaaaggaacatgaattgggccttgaacgatttggagaggtggtgagagggcacagatcattccagacagggcagtggcatgggtggaacaggaatgatcatagcagatatctgttggggaggaacatgtgtgtggtgggggagaagaggaatacgagacaatgaaatacccaccttgctagggtgaagaggatccactgattgctaaatttagatgggctgagactgtaaagagcctcgggaacctcaagggctaactgcttcatgtcctcacatgcctgttgactacttttctcatgatgattaaacagcttaagaaaaagaaactcagtatcttgggcatggggtaatttcttatgcatgacaatggttttcagcattgagctaaacttccaggatatgccatttcggcaaccacatgatctttctctttaggagcaagcctcttttgcagtcaacatatcctggaaactttgttctttggataggcaggtggaaaacattagaaagctttctgaactcaaagttgggcctgtcctagttaaccagccggctcacttgggctttttgattagtt

SEQ ID NO: 432 - DNA, 8000 bp, Homo sapiens
  Locus number 44 genomic DNA region, Feature name ha1p_42350_l50
tgccctccgttccctgaagaacaccctccttttccctgagtgatgagattcttgtgagacaataggtaaagtgaagataaatcattttgatgattttcattcaacgatccctggatcagggttaggggctcattcataagaggactagcttggctaatagctcatttctgatttaacatcacatgaagcacgggggttattgtttacaatctgaaatgcaatctaagtttacactgcagttaatccagtatttttaaatgccaaactactggtacccaagaaatcatctagactcagtcttgccaggcagctggagcttcagacttctgggacccaaagaggcttcgctcaaggtataaggagtggttcacaagaatggcttccagctcccagcccagggatagcttcagatgatctgggctgtcagagagtgggctgtccacacagcaagtcagagaccctcactgtgtttgcccttcaaggtttgcagaacctcgcagtacaacaggaagagtccgtctgactcagagctgggcatgagctggaggcatggagggtggtggtctctcaggaggtactggagtccaactggtcctttttccccagagctcccgtggcagtccactgccaagatcctgctaaaaggagaatggcccatgttgaagaaaactgggtgaccacattccaggataattaatgaagcctagtaagaaagaaaccagcaatcaagccagaaacagaaaacgatccctctcatgcctcctccctgagctatgacttgctgggaagggaaaaggactatctggctggacaacccttaaatggatgcgtcctaattaacggaggatttaattcatcaaagtgacagcgactctatttatataatctccttcaacagggctgagggtcgggctatggggtttcttacctttccctttccttcttccttcttctctctctctctcctctccctgcccgctcctctcctcctgcccccttagcttttctaatagggccatggcaagatttaaagaggaaggtaatttcaagcacagaattgttccaccatctccccagagtcttcttaatagaccccctcagccctccaatttggcctggaaaacagcacagtcctgttccagaagcaaggatgacagcaagtgctgcccagaagcctggtgggggaagggagagggcctccctgcaggcaggaacgtgcattacataccacaccacatgccacgctgtcacagatcagacagcggccctggcagactctcagagagcccctcattttacggatgaggacactaagctgggaagagagggagtgccatgctcaaggctgcacactgatcatggaagagcaggaaccagggctccccctcctcccccaactctgcttgctacctccacaactccacgtgtggcagctgctgagaacactcccctggtgaaacagctccccaccgtgctggctccttcctgtgggtggaggcgtcctcttctgtaatcattttttattaggattaactctgtgaattgtcattgttaaaaatagttaccgtttatgaaatacttaccatgggtgaagccctgtgctacgtgttttccctaaattaatcttgtccacattgtaaggtgggtactaccttctcactcatattttaagatgaagaaacagcctcaaagagattaaatgacatgcccaaacagaaggtgactaaccgttaagcccattcttctagccacaagctataataccacttttaaatcgaaatgactcccagagggcattaaattaagctctttacattttcctgtggatgaatgcaactggaactttgtgttcaaaaagacatttccccagcccagagctccctgccactggaggaaaaagcaaagtttccccctcgtctctgatttgcctgaggctcaagttctgctcccccaaagtagattccagggtaagggggatctccttgtaaggctgacatgtatcacatagccaaactgccaggtagtgggcagcagcagctgtccacaggtcacccccagagtccacagaaccttctggaaaacatctacttccatcccttttcttaccctcaatatagaattccacccaggcttgtcccaggcttgtaagggcccatgttgtagctgaattaattgggcctattagagtccagaaaagaaaaatgagtcccggtccctcctactcaggccattagtcactcacggcagaatcctaggtccaaagaacagttcccttcccaaggaagaagagaaagtgggggtggagagggagaacacaaaacaaaaacgccaggaggcccctgggcaagggaagtccctttcttctaagttgggtcacaatcacaccccatccgtcagcaccaggatgaaaggcctataaaaccaacacagcacctgagactgtatgaaaatatatatcctgatgtgtcaggaatacctggcgcgcctttaacctcaacttcagatgaaccaacacgcctcggagcacatttatatgcaaaggcatataatatgtcccctgtatctaattatctgtcaacctgaggcagtttgttttccaaatcggcctctcggctgtgactttacgaggtcataaagaaaacgatgccactctgcactgaaacgcaaggagagcctggatcaacaaattatactccttaatggtgtctcttggcctggagagtcaggcctggcagggagaaaggaggcacagtcccgcttccctacaccctgccttctgctgaagaacagagaaaggggtgcatgaagcatgaggtaaccctaagaggccccatagcatcagacgcaggtcaagtctgagtagaagtgacttccttctccagctcagcttcctcagtttttcagctctttatgtgcaacgtctgtctgcaaagtctggacacctccggagacacaactgagctggatgtctctgcagtcttcaatatcacctcgggccttcttgaattgtcctgtgccatggagcatcttttgctcctgggaccccaaggatttttggttgcagaggggaaaactttaatccattccatgtgcaacagcttctgccttcaggcatccaaacatcaagatcctatattccacaaaaaagttggttgcaaccgggtgcgggggctcatgcctgtaatcccagcactttgagaggccgaagtgggcagatcaccagaggtcaggagtttgagaccagcccagcccacatagtgaaaccctgtctctagtaaaaatacaaaaattacccaggcgtggtgggtggcacatgcctgtaatcccagctactcgggaggcggaggcaggagaatcacttgaaaccgggaggcagaggttgcagtgagccatgatcgcgctgctgcacttcaaccaggtgacagagtgagattccgtctccaaaaaatatgttggctggaagatattttattccaccgttgtatctgggagaagaaggcttgggtgactccctgaaacttctaagcaagaggagaaaatgtatcctcccaaagcagggaaggtaggtggcagcaacagcagcaggaatgctttgtcgctggtgaggccatctctctcccgccaagctcagcaccacatgcgcgcacgcgctcacacacacacacacacacacgtgcacacacaaagggagagggcggaggggtggtctcgcacacagtcttcagctcctattagtcctcctctgatctttagcagattaattaggaagtttgtcaggaaccagccgtgaactccagccgctcctctctgggagtggtaacagtgccagcgaaatctaagctgcaggaattcctctagccacgctgctcctatgattaatgatagaaaggaataaaaaaaagaggggtcaacagctgagtgcaaagcaagttgctagacagggagtaattaagatacttgggtaaatatgattaataagctcaaactggcagggtgtgcagtaaacaaggactaaccagatggtcccctctcttaggagaaggctgggcacttagaaacaagggggaatgggggtgcgggggagactgaaggaggagggaaagaagggcagcttggaaggtgtgattgcaatgttactttctttagctgaccctatctagaggaaaaggttgggtcccccgggagggatcaggacagggaggttgcttgggtaggtactctgccggccctcttatcacaggcagcagacacaaagctggacatagaaggattcctgctcagactcaaggccgcacttctaaagctgctctggtcctactcccttctccccctacccttctgccacccctgattccctgctttttccctcatttaccagcaagctgcagacaagacatacagtacacaggtcagtgtcaccagattcattcactttggctgcaaagcaccacgcaccccagaccaggtaccttcaacaacagaacatgctgtctcacagttctggagcccagaagttcaaggtcaaggtgtggacagggtcagttccccctgaacgctgtaagggagcatttattcgaggcctctcctccagcttcacatgggctgctggccacctttggtgtcgcttggcttgtagacgcgtcgcccagatctctgccgtcatcttctcatggtgctttccctgtgggtgtgtctttgtccaacttctgcgttttcataaggacactggtcaaactaggtcagggccaaccctaatgacttcatcttagctaattatagcttcaaggacactatttccaaataaggtcacattctgaggtgctggcagttagaacttcaacatttgaattcggggtacacaattcaatctttagtagccatttataaggtttgaaagcaaaccgggtcctactcagaactgaattgggaccaaaaaaaaaacacaaagctgtcatagcaatgtgggaaggaggatgtggcaaggacccccatctctcagctcattgctaaaaattatgcctctcctaagtcctaaacaataccttagaaagtgcatcctttggtgtgtgatgtcaaggagacacttgacgcttccagagatgatgttgagaaagaaccatggttgggtgtcccctaagatcctagttaacaggaaatatctgcaggccccagaaaagaagactcaaaagatttaccttaagtaagtggagatgtgctaatacatttcatctgcagctacgggcggctccacactaaggacaaggcactgctggggagacataattatatcctgctctgaaggagcctgcagtctgtattcctgcgttagttccctgtggctgctgtaacagatggccaccaactgggtgtcttaaaaccacagacttattctctcacagttctggaggtcagaaggccaaaatcagcattgctgggatgaaatcaaggtgtcagtgggactgtgctctctacagaggtgccgggggagtctggtagcccctacattccttggcttgtggcctcatccctccagtgttcaaggccggtatcttcacattcacatctcatgctctgtcttcacattgcacttcctctgtgtgaaaagctccctccacctcccttttgtaaggatacatatgatttcatttagggcctggctggataatccaagaccatctttccatctcaacatccttaacttaatctcatctgcaaagaccatttcttcccaaccttccataattcccataaaattttcttcttccagtgacttctctcaactgatctgcatggaactagacagcccagtcttttccttgatctcacagttaaggaaagccaggcccatggagggcaaagtgtacttcttcacagaaagtccaaagtcaggattgggtgagggcttcgtggggacttaaactcttcctataaatcagttccctatcttttttatatcacgtatctatttaaaaaatttttttaagagggtgttgaaaatgatagtgttgccaacttttttatttggccaagtaaaaacatttaaaaaaaaaacagctaccatatatatttatacttcttaaagaaagacatcttaattttaaaaagcaaagtaagaaagattaatcccagaacaaagtatagtcctcccaaaaagactattggcaactccgcacgctccatacactccacattggtcttcattttattgtgcccaaggttgtaacaattcattaaggacctgctattgaaaaagatccttccgtgcagcataaacctattttcagtggatgattcagttgggcttctcccaggggaagtgcccacaaatgtgaaccccacagagactcaggagaaaaaggaggagcttcatcagccttgctaagaggaggccttgttctcatcctcctgccccataggaaacattctcaatccccaaaggcaagtgcggcactgaccagaccagtctggggggccaaccagaccgtgcagcccagctgccagggcaccctgcctcctcccaacctctggcaagtcacagacctttctctcaattatggagctcagcaaacatcctcagaatgtttctttcattatggggttttgtcttcgcagagatgcacttggtaggagtgcgatactctggctggtgaaaaacttcctggtgtcttcctctttccccctgaaataaagtaattatagaacgggtgtgatggctcacgcctgtaatcccaacactttgggatgccgagacaggctgatcacttgaggtcaggagctccagaccagcctggccaacatggagaaaccccgtctctactaaaaatacaaaaaattaactgggcgtggtggcgggcacctgtaatcccagctacttgggaggctgaggcaggagaatcacttgaacccagaaggcggaggttgcaatgagccgagatcacaccattgcactccagcctgggcaacaagagtgaaactccatctcaaaaaaactttttaaaaagtttttaaaaagtaaagtaattataaacccccccaaaaaaaatgaacagcgtcttcacagaataatgctgtgggaaagactttttattgagaacttaactgcccttccaaaatgccagtctccacccctttccttgctaactgcttttctcccagacagggtgacaattctgctctgaagtcccaaatctgaccagtgagcatgtgtgggagtagttcagcagacatctaatttatccccataatgacatggagatacgccctccctctttctggggcattaccacttggcaggaggagattttattctcaatagctcgtttattttcctcccaatttgccatttgtaacaatagaatcaggataaagcagataagatcagatgctataccaagtcaggaccgacgcaacctcacagtctcttaaagggtggccaggacagggcagccactgtcatcacctgtctacctaaggctctgggcaaacttctcatccaaagggccatgacagcagtagagcagtggttgccaagacggttggatcacctcattctttagtgcaagatgaggtcctaagctctaaccagcccccatgaaaacttacaaaaaaaaaaaaaaaacctttaattagggaaatgagcacaagagaatcaactcaacaaaagtatgggcaccggatgtatgcccagcactgcaccaggccttggagaggcagagtttctgccctcaaggaggtcactgtgcaggagcccgatgctggatacccacaagtgcaatgtaagggctgtaataaatgtgtacagtgagcgtaagcacggaggaggggctctgttttcagtgtgtgttccccagaaacagactccaaagcaaagcttcaggtacaaatagatcattcgaagtaaactgaaaaaccactgatagcggagtgacaaagtgacccaggggagggaaggaagccaggcagggttcattgtcaccagttgctacaccagatgggggagc

SEQ ID NO: 433 - DNA, 8000 bp, Homo sapiens
  Locus number 45 genomic DNA region, Feature name ha1p_44897_l50
gtactcagtttgcaggattattgggttagaatgaaataaacattggacgtgtagctaaaatattgagtatgtagtaggttctccataagggcagctagtgtagactttttagctctgatcaatgtggaaggcagaagttcctgcccaggtctctaggcaagatgtagatgttcaaagtagctttgaactttctcaaaaatccaaaggcatttttggtcatttgtaaattaaatcaccatgttgtttccaggactaaatacgctatagacagatgtaataaccaacctcattaaaaaatcttaaactttttaaatattaagaatttaaacaaaagtgtatttggtaaacacttttatttttcttttaatttcaattggaatagcctaacctgacaacaatgtacccacaaatgttgactacctctattaggtgtaaaaagaacccagctgtaatgtttaatgtggtgaatggcataaaggaacatgcaaactgatccaaatgtttataaaccaagtattcctctgggactcagtgccctgactttatgttttttaaaacatagagagtcaagctttgttcatacttgaattatgtacattgcattagccgtgcaatttaactttaacccacaggactgcaaagaaaattagctcagcctgcagaacaacgagaccacgagcaagtaagcacgttaatcaaagtgaaaggctcacccctcacgtctagctccgtccttctccagcctgtgcctgccagattatttcgggttcctcgtgtttgactcgtcaaagtggcagaaacaggctaaaatgttcactgtggaaaagggatttgccttttaaattaatgtttgtgcacatgccccgaggaggctgatgagaagcacgcaatttttttaaatcataagtgaatgcatacccttgccactagtaatcatgacaaagcttaagtaattcaggcatgggcatggttttctgaaagtataaaacaggatttactagttgagaatgtctgcctaaacaagctcattgctttgaatattttcaactatagttcacatttgtttaacccgagcaggtctggtaaacgtaccacgtttactgattgagtgtcttggaacatcacaaaataaaccaatacatggcttttaggctagttttgacagagggtggacagagaaccccacagggggtttggaaactgccctggcatctggcttacaagtaccagtaggggacctgaccacattcaccacccttccctgtaaagggaatagaacactatttactcatctcctgggagcctaatatggattactgttgttgtcactgtcatttattattcccgacagaggaggcagatgacttagttctatgtggtcagagttgattccataacatgtatatttagcctacatgataataatttgcgagtatttttaaatgaatgtctagctttcaaacgtcattgatggggaatatctcaacagacatgaagagcattcaatgcctaggtgtttgcgtcaacctcctcccaccccactctaaggactctgcttcacagatgaccgtatattgaattggtgccttataactcagcgtgatcatctctctaattctcgacccccatggtaaaggaggaattggcctaaggacactccattctaattttctgacgctgtcaatgctaaccagagctcatagagcaatgatgtgggggtggggaagatggttccaccattggtgtgagaccaggagctactgttttcgttagagccacatttatttctggagtagttgtgggagagagatgtactccaaagagaagaggactcttgctatggttcaggtatgacccaccatctggacaactcaactcagagactttaaagtgtataggatataggagggcagggtacattccatacactaagctaaaaatcacttatgctctggggcaggagatagcatgagagctagaaacaaaagatccagttgtgaaacctagtacctcagctaaggtgtttgaacatattttctcttttaaaaaaattctggggagcttcaatgtgttgctaacctgattattttcagccagtccttacagaagattgaggtgctggaaaactagcaaccccagaaaatattaattcatttttgcaagcgttaaaattaacaacagcatattcagtgatgcaataggcaattaaagacttttggagagataagaagaagaaaactataaatattatatattcaaaatcagtctcagcattttataaaaatgttggcttatgtccaggatctaagggtgggggtgggtatggtttctttgtagctatagagtggaaaagaatctgttctatttccttaaaaataaaagacttcttgttttatacagcatggcaaataaaatgcttttttgtttttttacctgccggcaggatctggaggaaattttgctagcaagctatgctgttttcctctttggggacctggtgacactggttttgcagcaaaaccgtatttgcttattaggcatttcttaaaaatcctgaataagcagctctttcaacagtttttgttccacatgttaaacatttcattgcaattcgagctttgagtgtgtgtgtgtgtgtgtgtgtgtgtgtgtgcgcgtgtgttgataggaaggaatgaaagggggtgcataagaattcttgaatgttttttatttaaaaaattaattcctcaccattacatattgaactatctgcagaaggtgattccaatttattacataccaccaaactagatcccatcaatcttgagcagtgggggtagggaggtggttttgaagatgacatgaaatttggtgtttgagtagatgagatttaattttcggaaaacatttcactcataaaacggatatcaacccagtgtcagcactgacctcctgatgtcaatgtcatcatgcaagcatagctaaaataagcctcaaagtaaaacaaagaaacattgcatctcagcacaacacgatttcttctcttacagtatgtactatctatagccttttggtattcctattaatggcttgttactttaaaatttagcttttggagggggagggagaagataaatcattttgcattttctgtgttctgaacgcatacagtatgctgctgtaagtcttagtattatttaggtcagtatcctaaggatagctttaatcgttcatgatggtcagctatacagccagaggaattcagcatcaatttatttttctgttctgattttattctgcttccaagttttaaaaaatccattcacattttaataaaattctgaggcggtatctgccgctctgtactgcagatacatttagcaggatacatttacactgcttgtggttaaaggttatagcacggatacagacagctgatcatgcatttttctacaagcctgccggcaccatttaggattttgaaaaataatctagaaatgctataccctttatcaaaattattttttactttgcaagagcttaacagttttggttttttcttagcaattctataaaattaacatctataaaatgcatcccggaccagatacatactgtattgaaagctttcttcaggaagagaatatgagagtgttctttccagcttattttcttccttagcaaaaggattgtttgattctcagaagcagaaggacacattcattgtggagcagctctgcttaagtgtatgaaatgccttctgtctggttgcagaatttggagtttactaaacagtgtttagtgattgggctcatcttgcatcaccagttgatgacatttttctttgttccctcctacccagttgaaccaagactctgaggctgatatgcaatgtcacttacaacattaatcagatactgcatttaaggtgagctgtcccttgcctcctccttccccagtgctcgtgtgctgcatgcagtgcgtatcttgcttctgcgagcctaagatggcaggcaggattagccgtgcttgtgctgtgtgtgcatgctgtgtctagaattcattacacgttgcctagtatttcagatgtgagtatgtaaatgctctgtatgccatatcatctggtagcgaagacttgtttttgcctcattacagccttagatatttcaacatcacctttcatttccaattcatttgcttctggatgtttgtttttcatcacattcaaaatatgattttacctttttttttttaacaaaaccaaaaccccccacaaaccctaaaaacaaaaacaacaacaacaaaactctgctaccagatggtgtctctcctttcttcgtgcatttgctgtcttttaaataatgtatgttgtattgttaattaatgtgaatatcaaattaaacacttgaaacttacatgtttattatgcaggtaggaggcaaggtggattctatttttaactcttatgcactccatcatgtgcaagcaacttgggttctcaaatttgtattttcaatgctggtatcagtggtttgattttcagcaaatgtgacagtggcctttgcagtggtcagctccgagctttgaactctcagaggaggaaggggaaaaaaattcaacacaccacctccttggttgcagtctcagaaaaaccttggatgagaaacttcttttttcaatcctgttttcctgttgataaattcagttctgtgatcacagttcattcaagctgttctgcgtatgatttttgtgtgtatgtgacaattgcatctaaaacttgtgagcaagaagacagagaaatcagttggtctccatcgctttacataaaaatggctgagtgtcttgtcatgctagcactgcattaagtgatgcatacaggtaggttgaaatttgcatgtttttatagttttttttgagccatgcagcaagaacattagatgcattagaatatgacttttaaaaaaacaaaaattaaataagacagctgtaatcttttgggggagggtttttaattggacagcctctgctattcagatagtatataaatgtatagcttttacaaacttagtaaatgattctgccataaaagggagattttttttaaaaaaaaatcatatatatgataggtgtggtgccattagacaacaaaagaattttttgaaaagagtgatgattcagctccatttcagcttgaaactaaaaataaatgggtttctggagatgatttcaaagagcgtaaacaagcttaataagaaacattaaaaatatttaaattttaagaagcggtctttaaacgtgtttatgaaagatgaaaataaaaactgatatgcttccaaaattaattttaggtaatatacaagaatacattatattatgtatataatttggggggatgaggagttacaatttttaaagagggaaatattaaatatagatggccctcttaaaagaaatagagcttcactaaatgaaaccgagcccctagaatggttcattgcagaccatatagctgtggttctggcacttttcaaaataatttcatgagctctttcttttgaacttaacttctcaaatatattttagtttcaaatttaacactgggccagaacctgtttccttggtaaccaaatcgtatttaaacatgtaataacagatatgcaaaagaatgtctttaaaaaggaaacaaatgtttaatgaaaaatttacagttctttttcctctcatatagaatctgaactggttttagatggtttttaatgcggtcttcaagccttaaaaattaagccatgtttctaaacatatagagaaagcttgcacagtgacagcttttctctccctcctttgtgctcagtactttcaaaattaaggttttctttgcagtatgctccagaatgcaggtcaaggtttgtgtacagaggtgtagtttcattatcacaagttcaccagcgccactgaaacaaaaggtatttcagaaattctgagaatcagaaaatgcttgtactcttgccttccctgatccctccgttggtaacctcagtgctgtcggtagaaaaggacccacatccaagcctacccctccaatgacaagtgcaccctgaacctttgtggaaatatctctataggtgtgttaggaagatggtgctaaacctgaaacctccccgaggtttgcttcaatgtgaagaacattgagattcaaaaccatctgtgtaaatggctgctttattctagcagtttaactaatattctattccatagcactatcgtagaattgaacctctctaatgggctgaagggtggtggtggttgttgtcatgttgttttgtggccaactaaaatattttgcttggagtctttctctggttcaattattttggaacgtgattcatctcatactgattttgttctccaggcttgccatgaaatacccttcctgcaacaccttttttttttttttttttggctgttgggagccattttccttcttgcctgtgactttaaatgactaagtacattttgaatatagtatcaatcagaagattgtaaactgaagggaaatatcagaaacctgattcaatattgcctattttttttagtaccaacagcattaacagttgcaataggatcaagctaattgtcattcgctcttgagcaaataatgagccaggcatttataattaaaacactactgctagtcagaaagcttataactacaatgtcttctattttgataggccagtacaaagtaatcattttgcacctatttgaatcttaattacaagattagatggatgcaatgcaattgttttaccattaaaatgaatgcctgatagattcaacagtgtatttcttctttatagaatgtcgattcttttgtttgtgactcaagcatggttgcgtcatcttgtagattttcatacttaatggcgtttttttgtggcattattcacttatgttgctcttagtcttgcctaaaagaattttaaacccaattcaaggatctagaaagccaaataagattgttgggaagtgtatcgtaccatcgtcattctaataaataaaccagtgaatagaataataattactatatattacttcgttgtgtttcaccttaatactttgccttcatatttcacagcaatcttgacaaggcacaaagctttcctaaacttacccatttacaattattattgaatttccaagattagctgaaaatgcttcttgatgattgtagaggatggcacttaccccatctcattgtttgaaaagctatcctgaacccatttacactttttggctccggtatttttactgggcaggccagagcaggtgtgacagcaagactgtgcaaacaattgcactgttctcaccaaaacaaaatgggcaaatatgtggttttctgttggaatgatttataatataaaatactataatatttataatactataataccaagattgcatctcttgccataatactagagtggtattgatctaccccatccatttccatggatcccccggagatggactgggaatcagactatgacttagagcctcttcactgttatgtgagaagaatctagaaagagatctagcactttctctttagtactaggtcatgctaagtctttaagttcctggtaccatgtggttcattctaacagctcctttccaagggaaatcctgttcttaacagctctcttggtaaataaacagtcaacacatttattgagcatctgctacatgccaggcatattccagaggacgggagggtgcttgcagggaggggaataagcaaaaatatagatgtaaataaagaaggcaagtgcacagaggaaaattaaaaattttaaaatgaaagtgggccaggcacagtggctcatgcctgtaaccccaacactttgggaagccaagacgggaggattgcttgagaccaggagtttgagaccagcctgggcaacatagcaagaccccatctccacaaaaaattttaaaaattaactggacacggtggctgg

SEQ ID NO: 434 - DNA, 8000 bp, Homo sapiens
  Locus number 46 genomic DNA region, glutathione S-transferase Mu 2 (GSTM2-2, GST class-mu 2)
gaggctgaggcaggagaattgcttgaacccaggaggcagaggttgcagtgagctgagatcacgccactgcacactccagcctgggcgacagagcaagactccgtctcaaaaagaaaaaaaaaaagcatgcattaaggcctgtgcactgtatgtgtattacacttcaatgaaaagcatgctcatatgtcttacattatttgtgtgcttgtgttggtttgctttccctcataagatgtcaacgtcctcaggacatgtgtttttgtctcttcttgttcgctgatgtaacaggtgtttgcatatcacctaggacagtccctgagcatagcaggtgctcactgaatagttattaggcaaattataggctctatcttaatggtgtcatttcaaattccctttagatttttatttatgcctacttctttggataggtgagattgatgggcacatacactcttaggttctgcagttttttctctttaacattttacctaagaatctgtacatgttggcagtctatatgcatgcctatttctagcatttaatggctatcattacttcctgtggataaattatagtttgcttagtcattcttaccctattgggcatgtggatttttctcatttatttatttttagaacagagtgatcatgtttaaactaattccttctctggtttttgggtactttatttgagttggtccccaaaggcaattactacaaggcaaaaggtgagaatggtgttatggtattatcatagataaattgctctctagagagaatagcttttttttttttttttttttttttttttttttttttgatgtggagtcttactctgtcacccaggctggagtgcagtggcgcgatctcagctcactgcaacctccgcctcctgagttccagcaattttcttgcctctgcctcctgagtagctggaattacgggcgtgtgccaccaccctcggctaatttttgtatttttagtagagatggggtttcaccatattggccaggctggtctcgaactcctgacctcacgtgatttgcctgcctcagcctcccaaagtgctaggattacaggcttgagccatcgcgcccagcccagagagaataacttaattcatggtgacacctgcaagtcacatggatctttctgcactaccttaggtacttgagggattgcagtttcatcttataatatttttataggtttatagaataccttcaagttttctaccttcaccttttttgtttatagtgtgtgcatgtttctgccaatgaatcacagtctatgaatctacccgtccttgaatctcctgtataaaactctctgtttacccattctctacctgtggcttagtcaactcctggagaaaggttaaagaatgatcttgtggcagtcaagaccttctctctaataggcacaatgtaattaattatgattctgttctaggtttcctgtggcataatgtgatggtcaattttctgcatcaacttgactgggctaagggatgctcagatggcaggtaaaatcattgtgcttgtgagggtgtttccagaagagatttgcctttgaatcagaagacagcaaagatttccttcagcaatgaaggaggcatccaccaaactgtcagggcccagagagaagaaaaagacaggaagggtgaatttgacctctctgactgggacatccatctctgcctatcctgggacctccacactcctggttctctggccttcagacttgatcagggactaacaccatcgcctcccacccccacctttgttctgaggcctttagcctctgaatgataccactggctttcctgcttctctatcctgcagtcggcagatcatgggacttcttcactccaaaattgtgtgagccaattcccataacagatagataaatttataaataaacacacaaatttcctacagccttatcttagtggtgtcacttcaaattttgaagaaccctgacctagtacacatagcaaaaaacaacaacgacaacaacaacaaacaaaaacacacacacacacaaaaactcatcatcaataagttttaaaaaatcaaacacaagataaaacgctgcagcatatctattacctgggggcttttctatatggaaagcactttctgagatgccttgcagtaaactccaaggagattttgagggaagatattctcttttctcctggtaaatctccctgttgatgatcattattttaaagactccaaagatgaaaacatctgcttgcacattttgtcgattcattttgggtgagggtctctggcaggcttggaagggtgggtgaacagtggaagggggctgcctctggtgactagcatcactcatatccatgtctgtggcagtcatcaggtgcttattatatattcgacttttggccacccctaatgggggtgttaaatgcaggaagagtccagtcaagtcattgcaaattggcattgacttttgggacctttctacacacgatagtcaggtagataccttctttttaaatttgacttgttattacttttttttgagacagggtctcattctgtcacccaggctggagtgcagtggtgtgatcacggctcattgcagcctcgacttctcaggctccaatgatcctcccacctcagcctctcaagtagctgggaccacaggtaaagggccaccatggccagctaattttcgtatatttggtagacaatgtttcaccatgcttcccaggctgggtggatacttttcaaaaataagttcagttcatcctgcctagccttgccccagcagctctagaggaattacccactctggtgctgggctcaggctgcctgtctctggaataatgtgctcagagctgcagggtaggcctgctgtctgactggcagagagagtcccatactccctaccctgtaccctgaaagatcaaggctgcccagcctgtccacctggtagaccatttccctgcccaattctccttctctcattcctgatgtgcagcttgatgcctgcagggactgtgccagctgagattgtctctaggtcctcccttctgccagctggtgtccagggaagtgggtcctttggcctgcttcctgccaccagaattttgaggaccttgtttctcccactgcaacttttgacccattcctgggtttctttttcttttttttgagacggagtcttactctgtcgctcaggctggagtgcagtggtgcaacctcagctcactacaacctccacctccctggttcaagcgattctcctgcctcagcttcctgagtagctgggattacaggcacccgccaccaggcctggctaatttttttgcatttttagtacagtcgggatttcaccacgttggctgggttttagactagggtttcttcacctcagcagtactgtcattttggagggcaaaatcatttgttgtggggcactgtcctgagcattgcagggtgttcagcatcctacgcaaactctacccactagatgccatgggcgcttcccagtggtgacaattaacaaagtctccagacagacctacatgtcccctgaggggcaaagttacctccacttgaagaccagtggtgtgctggatggatactaatattaaaataataataataataataatagaaatcataatataactcatgtagttaaggtaagtcctttttgatggaacatttatttcagttaataatatttgtgtatgtctgtcctggtagttttttttttttaactttttattttgatttaacatgagagtttgagaaatttacaaaacgaatgaatacaaagacctctgattaccccagattctaacgtttccacatgggctttctcctccctccccaagtccaccagcccctgctccccacctttctgtctctcttcccacccagcaagctccctaggagcacagcaccacttatgacaaaaacatcattttcttttctctgaggcggtattcctgacgtttggatttaggctgataagtgacagtgagttataatcatccttgcctgtgttgtccttcccacgttaggtctgtcatgccacgtatgtccgcagtttataacaatctctatcatacattgaaaagttttgaaaacttatccagtgaatccctgagcaccaaatgttcttttgtgttatttttctttattaggctattattactttattcagaatctctctgttttagagagagcctttctttcttgcctaacctagagtgcagcggcgcgatcatagctcagttcagtcttgaacccctggactcaaccagttctcccccgccctgggcttctgggcgtcctgatctctctcctgaaacccacggggctgggaggtgggaggagatcctactcctagccccatgagcgcgctccaggcctccagattggcccgtttcgggggcagggcgggccgtggggcggggtcgcagcaaggcttcccctctaccctctctgggcctctcacaaacgctgagccccgccccgctgaggcctgtctgcagaatccacagcaaccagcaccatgcccatgacactggggtactggaacatccgcggggtgagccagggtccgctgggcggtgggacgggggtgcgtgggggcggggaagtgtggagcagctgcaggacgggctctagggacggttcctcttcagggctgtccctgacagcggggtctgtgcttgccgctgtctgtgcgtgtggctgggcgtgcggggtgggggcgggtgaggcaggaacgagaggaggagatggggctccccttgtgcagagtcgtcacaaagtcagggaccctccatctctgacccgagctgtgggccatctctcccagctggcccattccatccgcctgctcctggaatacacagactcaagctacgaggaaaagaagtacacgatgggggacggtaatggcaccctcgagtctgggccctgccccctcacactaagttggcaccaagcaaccgatagtggccacctgtggctgactctgcaggcctcccttgctggaactgcaggctgtcccttccctgagccctggtgagggagctccttgcaaggcagaatgctggggcgggatgctgggcccccgtctgggtaattatgatgggtgtccctcagggcttgcctaaaccctggaagccttagctgtgtggggtccagagccctcactggaattctttttctctgaatcctgggatgtgggactgagtggtcagattctagatccacctgtctcaggggtcttgccactggctccttgggagggtccccaggaaggagggctgggctttggggaggtttgttttcacttcatcttccccaccacagctcctgattatgacagaagccagtggctgaatgaaaaattcaagctgggcctggactttcccaatgtaggtgcaggggaaggggcggttttgggggaaagtgcgacgtgtctctgactgcatctcctctccccagcttagaggtgttaagatcaggagtcttctgcccaattcctctcactcttggctgtctacacagcccttgcatgatgttctgtgtcccagctcatttattagtgtgacagtatttctatctcaggcctgccatgagcaggccctggtctcctctttgcccttgcatatgggaaggggatgctggggagcctggtggcccaactgagcttccccggtttcccatctatccagctgccctacttgattgatgggactcacaagatcacccagagcaacgccatcctgcggtacattgcccgcaagcacaacctgtgtgagtagatttggttgcaagatgcggggagggaccgtggcctcctcctcggcttggctgggctgtgaggctgagagtgaatctgctttacgagggtaggcggggaatcagaaaaggagcagattcgcgaagacattttggagaaccagtttatggacagccgtatgcagctggccaaactctgctatgacccagattttgtaagtccccccaccccactcccagtctccccttccctactcccagtctcccctttccctgcagagtttgtgtccaaaattgattccttctggtgagttcttggtcttgctgactctaagaatgaagccgcggtcctacacggtgagtgttacagttcttaaagatggtgtgtccggagtttgttccttcagatgttcagatgtgtccgcagtttcttccttccggtgggtttgtggtcttgctgacttcaggggtgaagccgcagaccttcgcagtgagtgctacagctcttaaaggtggcgcgtctggagttgtttattcctcttggtgggttcatggtctggctggcttcaggagtgaagctgcagaccttcatagtgaatgttatagctcataaaggtagttcaaacccaaagagtgagcaacagcaggatttatggtgacgagtgaaagaaaatacacttccacagcctggaagacaacctgagcaggttgctactgctgcttgggaagggcggaggtggggggggaaatcccttatttggccccacccacatgcagattggtccattttacagagagctgattggtccattttacagagtgctgattggtccgttttacagagtgctgattggtctgtttttacagagtgctgattggtgcgtttacaaacctttagctagacacagagcgctgatttgtgcatttacaatcctttggctaggcagaaaagttctccaagtcctcacctgacccagaagcccagccagcttcacctctcattttgatcaggagccaagactgtggtcctgccaaatacacgggtcctgttttctgtttgaactctttagtgctactcatccttcaagctatttcctatactgccaccagagtgaccctcaaaccccaaagtcgtgtcaaataaaacctctaaatcaattccccaccaatctacttatagaatcctgactccccagggtatgaattcactctctagacagtaatggttacttccagaatcccttccatctctgacccatgacctgtgctttgggccatctctcccagtggtttatatcatctgcctgctttaggaatacacaaactatgaggaaaacaagtgcaaaacaaaggagtaatggcacctgaaattttggtgtcttccgagtgctctcttgacatacactgagatcagcgaattttcctaacagacagcttaggggcagccagaggctctttttccccctcctttcttccacttatcctctgaatatctcctcatctttccagaaaccactcaatgtccattgtattctactgctgcccaactaggaggaaatttctacttctttctctgagctcctttagttctttgcatccttgattctgctcatatctggtccagagcctaccaggtgctcaggtgctcctggggctgacccagaggttgttgggaggtcagtggggacagatttagggacagtgtcacattccgctctgccatcccatcacctcagaaagactccagctacccagttggagtctaataaatgctgatgtatccagctgaagcctggacagtgacccagttccagctgtggggaagatgactgcttgcccgcggccagctggggccatgcacaaaactgggaggccgcatctgtgcagggagcttgtgtctgagggtgttgacagctgttttctgcctcaggagaaactgaaaccagaatacctgcaggcactccctgaaatgctgaagctctactcacagtttctggggaagcagccatggtttcttggggacaaggtaatgggggcgtgtgatggggacaccacagatttgtcatacttcctatattatggaggtttcagcccacatatccttggccttatccagatcacctttgtggatttcatcgcttatgatgtccttgagagaaaccaagtatttgagcccagctgcctggatgccttcccaaacctg

SEQ ID NO: 435 - DNA, 8000 bp, Homo sapiens
  Locus number 47 genomic DNA region, Feature name chr01p001005050
ggtggagggccctgtgctgtgcagggcagagctcggctgcacctgggccaggacacagctgcccaggtgggaggaaccgtggacggggctggggccttcctcgtcccagggctggtgagctgctcgctcactgtttctcagttccaggtagacacagtttataattctgcagaaaactctggggccttttgcctttgtgttttcttttttgagacagggtctgactctgtggcccaggctggagtgcggtggtgcgatcacggttcaccgaagcctccacctcccaggctcagcaatcctcccacaggtgggcccacaggtgtgcaccaccacagccagctaagttttaaattttttgtagagacggggtctcaccatgttgcccaggctggtctcaaactcctgggctcagttgatccgcccgcctcggcctcccaaagtgctgggattacaggcgtgagccaccgcacccggatggtgttttaccactgaggtcagagggcagacgttgctccaagcgtttcgtctgcgggtggagctttggaactgatggagaaggcagagtcctgaccaggggccgccatcagagcgcagggacggtcgggggggatgcgcagggaggagggaagggaaggaaggaggtgccaagccctccgctcagtggaggtcagtggaggtttgcttcctgctcacactgggcctgattgggtcggagggcacgcgggggccgctgtctgtcctccgtggggccttggcttgtgtccaagggagggagacagtagagggacccacggctctgtgaggcgttccctggcatgacctcacctgtgtgctctctctccctgtctcagtcagagctgaacccaggctcctgtggaccaagagggggtccaggaagaactgctcctgggacccggacagagcggaggccgtgtgcacgagcagcgtggaccagaggggcctcgggggccacctgctccgtccgaccaggcaccagtccttccagactcgcctgaggatgcccgtgggccccagcgacacctggggtgccccccacacccctgcacctacctgagaccaagggtggtggtggggctgtgtgcctgagtcctggccctcccagggccaccctcaggagcggctgcacaggctctggctggccggggctcagagcagcccacggagccaggcccatcctgggaggctcagggctgcagcccatggactcatgaggggggcttctggggtctaaggccagaagtgacctttcttctcacggaggcacccccacatcacaggccccaagctcccaccaggagtccccaggcagcaggttttccaccacagccgggaagagccccgccttcaccacccaccaccagccaatcccgagaccaccgaagcccccagaccgggccctttgcccctcctgccccccggctctccctactgcccagagcctccgccagcacccagggacccacgtccacctcccagagcggccctgcccagggtccttccctgccctccacgattctccgtggcccttggagaaagagcagcttctccccaggctctgcccccagcccttccaccccagagcctctgcccagacgtcccgtcccatcccggggggctgtcacgcttccgccccacctctcgcccattcccggacagtcacagccgtggaacaacgcagcgtgtggacacagccccagggaagcttgactctgcctggtccccatggcgtgcggtggctcaccagccgcccccatcgctccatgaaatctgactacacctgtcccaaaaatcaaccagctcccaggcaggtcccgccgtgcagggggccaagggccacacctgggaccagtgagtgaggcggcgtgcgggtagtgggggtgtgagcccgagacgggggtccagccttctcccacttggatgccaacagcagactctggatttggaggtgtgggcggtgccttagtctccccagaagacaagagcccacccgccgggtgtgtcctgaccccacccccacctgccccacacagacacctgagtgggcatcagagtgggccgggccctgactgtccgggggagggactgttggggcaagggcagtgggtcagaggtcaccggtgcccccaggaccagtttccagcgagaagagagccaggagccccgggcacaggcccacggtgatgaggctcctgaccgagctcccagagctcattatggaaaaccgtggggtccgctgggacctctctgctggtcgggctaattacagaccgtttgtcgtttcattatgggctcttcctctgggagatgcgagaagcaaacactttgccatgggaggggcgcttcccggaccgggcgggggccctgccctccccacccccagacccctggtcccccaggccttccaagctcccaaagaaaacttgaacccccactccaggggctccaaagtaacctccagagcccagatggggatgttccgggagctgctggggcctctcagctgtccctgcctcgcagggaggctcaggaaggcacccacacccctccctcattcccccagctgtgggtctgtggggtctcggagcctcttgcccattggggtgggactgggggcacgtagctcctccgagcccctggcgaggagaccgatcctgagacccacctgggcctacggggggtcccttcattgctccaaaattaagggctgcgggcctggagcaaagacaggcaggtatggcccctgccctctgtccatgagaggcctcagccccatgggacagggcaccaccgctgcagggaggcggcgggcaggttgtgacccctcaccctggggccaccctacccgcttctaaggcagcctgggaaggagccctgcggagctggggggtggggaggcagaggtggagaggcgagagttgcccgcggctgcccctacccctgcccatgtcgcccacactccacacgggccccacagaagccttcccatcctggcttttgttcaacctcggtgggcggcaaggtgggggcgggacggagtctgcggggcctgcggggcccgggcctgcgtcaccgtcactggcccgcctcccgcccggcctatgggagcccaggggacacacctgtcgggggccaggagcggagattggccagcgggagctcgcacctgtgtggggcggggagcactgctccttgtaaggcgagcccccgccgagccggctcttccctcccgaggcccccacctcgccaccgcctcccattgtcccgtcgccctcgaaactctcccagagacgggcgagttgtccacctgtgcaggtctgaactgacttcctgtgccagggcctcgcctgagcgggggcaggaagctcacccttgcaggtctccccgcgccaacggacgccctgaggcctgaccctggctgaggcagagcacccagctccgtggaccgggacggacgggctcaggtgccccccattccttccgaagccggttcacacccacccgggcctggcacaggggaggcgctggctgcagggtcggggcgggagcagcctcaacccggctcctgggccgcggccgcagcagtggaacctgtcggggcaggtaagggcgggcagcggggaggctgaggcgcagggggaggcggctccctgcaggggggccctcgccagcccccgccgtggccgacgtggggcaggggcgcaggtgacagatgggctgtcgccagcctggccagcgtccaggggagctccggtcactgcagacacaggctggagcgggtccttcccccccccagggaaaggtgggcccctgcgcagatgcggctgggtttcgggtgtggagccatcttggacccacgggctgcgtcttccgggcacgggcacagtgtgtgggctccaggcatggggtgccctcagggcagggcctgggcagagggcaggctccgagaggggtcacgttcttgccgcctacctgacagcaggccttctagaaagttctctccagaagcagccaccgccgtcctgaggcactttgtgcggagacgggaagctgtcgcctcagaggtgggtgcgtagaagggtttggccgggtgcgaggatgaccgcgtctcccttgggctctggagtctgcggtgggaagggcttggtttcagcaccctctggtcagaggccggccgagcccatgggcggtgaggttggtgcctggggtcgtggctggtctggtacaggtggggctcagcccggagaagctggagccggttcccaggccccgcgctatgactggggtgggggcaacgtctctcgtgaggttttttacttaaatgtgaaacggctcagtacggtggccgcagccgggaacaaggtccgacccaccgaggcccagccttgaacttgccgcgggggcacctgaacacggttttacagcccggatcactggctttcttgaagtttgggaactgattgatcatggtggcgggaggtaaggttcattgttcttgatgaacaaaattcttagggcgtgaagagccgatgctttaattaaccccccgggagcgtctcaggcctccccccgggagcgtctcaggccccgtttacgctgagtgtctggggaaagacgtggtttggttttgtttttctagtaacccagatgaaatgtttaaaagcatggttggcagcacattgaatttggcaaaattaaggtttgcatttgtgaaaatgcggatgcagtttgcggttcttttcagacattttggtaatttgcaaatacttatttgcgaaacgagtttgtcagaacattttttagtatctagaggaagatgagatgggccgaggaggtcgcgcacccctggatccctggaggagctggtgtgttctctgtggggcgggtggacgtggcccggacacacgggccgtgctcacagccggcctgcgagggctgcaaatccacgcccgccgtgtgggtgaaatggcggctttgcctcccagacgcgtagctccggcgacgcagagggaagaacctgagtgcccgccaggccgagctccgcaccccaccccccggcagcctctgactcccggctcggctcccgcggtcggggagggttggatttcacactttgttctcgaggccgcaccattgattaagcccgtcgggcaggttaaccaacaagttaggttttcacgccgggatcacattcctcgccgggcgctcccaccccaccccagcctgtgcaggtgggacccggccaggcaggcgggcagggcggccaggtgcgccgaggggcgcctccacggggagtgtgctccgcagagaaccccttgctggggcggctctgggcctcctgactcactcctggattttcccaagctgagtctggccccgcggtgatgattaacccaacacctcaaccggcaccgccacgctagctccacttcccggcgacggttgacaagaaagcgccgcgtggggctctcggaaaacagggaaggtccgttttcgcttttcatttcttgacctgtggccacggtaagactcggccgcctgcccacccgactccttgcccctcacccctgtgccaggcacaaggccctgcgaaatccttggtcccccagctgagcctgccggcccaggccaccatctccccacccagccctggagccagggtcggcctctcctgctagctgctcgttggctttacagcttctgcactcaggaggcgcctgggaatcctgccctggaacttaggaaggaggcttctcccacctgcctgccacacgggtctgtccctgggtcccagcctctgccgtgtgcccctcagcctcccgggtgagaacgcaatgactgatgagcctggggtggccaggccagctctggccctgtggggttcctgagaaggctggccctgggtggccaagggcctggggacactggccccgggccctgaacctggcagtgggaggccggcccgtccgccgggtgggctgggaactgtgtttggccccagctgcaagggacgagtgccgggcacctgctgccctccccacgtgacctggcagccaggaatggagctgaaattcaactctgctctgaacgggaagtcttagtttcctttagctcagaaaacaggtgaaattgtgttcctgaagcactgatttgatgggatttgatggcattggtggcgaaggcctgtgaggtgatggaaagggaaagccgggtgccctggagcctgacaggctggggccagggcaggggacctggtgtggggtctccggagagggtccaggcgtgagggaagctgggtcaggacctcggagacgtggcctttggaggaggagactggaaccgggtggacccggcagcaggcgggggcgggcggacacgacctttgttgtggtcggcgggcagacaggggaatcggcacagggcctgcgccccacctacagcctctgtgggtggaaggtgccagaaaacttgaagagtggctctggccagctctctgggcccagttggcaccaggtggttgcagagaaagggtgggaaggaggacaggaaggacggcgtgtccagcgggcggggagccttggtctggcctgagggctgaacctccctcgggtcctgagtgtgcctggagtagaagcctagggtctctgggctccaggcagggccctgagcaaggaggggccacagggctgcccacttcctcctgcccccctgcagaggcggctcagccctcgcggcgtctgaggcttgactgcctgtgtctgtgtttgtggccggtctgcctctgtgcctgggtcagaccccagaccagcagacacacaaaccgcagggacggctgggcagggtcaggagcctgccccgcccgcacccccacccacacccccacccccacccccgcctgcaccccctgccctcagacgctgtgcagtgagcggggcagcatgggagaggggtctccaggtggcggggaccgttctgtctcgagagcctcgcagacaccgggcctttgagaagagaaggggctgggcagggaagcagctcctggaacaccatcctggagacagaggcccttgtcccctgcctcagacaaggcagcacgtggggcccggggggctggggctgctgtccaggccttcctatgggaccacccagagggaaggtcccccgcagaggggtgggggcagagggccgagcggggcgggcagagggcccgtgtcagccccactccgacctagtcctcggccgtctggccaggacacttcggccccccaggtgcccaccccaggacccaaagctggtggctgctggactcggcagggctggcgggtggggctcacccgggcccctgccctccggcgatgctgtcctcagtgccccaggaggacgaggccccccagctactgagcttcccagcgagtcccatgcaaccctcagccgggcggcccccggacccagctcgggcagccgtggccatcttactgggcagcattggatggagtcaggtctctaatactgcctggtaatgatgacggcggagccctgcacgcagcgaccggccgaccccgtcccggcccccagggcctcccgccgagccccacactcccctcccacacagcccgctcaccggaccccaccccgtccgggccagatggctctggggagagtgacggggggacgtgaccttcggaagggggctggggcgccccccaccagcatctcagagaccccggaatgcaaggcctcctgcagctgcacccagggcgccccacagtgatctggggattaggacgctcaggtgtccgggccctgcccacagcgcctgggcgggagctgctgtcacacccagcaggtgcgggccgagcaggacccaacagagggctcaggagggcaaggcccaaccgggagccacgtggaacccagaggaagccgccccacccagcttggccacagccatcttccctcctgccggacagggtgggccggcc

SEQ ID NO: 436 - DNA, 8000 bp, Homo sapiens
  Locus number 48 genomic DNA region, voltage-dependent T-type calcium channel alpha-1H subunit, voltage-gated calcium channel alpha subunit Cav3.2
gccagagagcagccacgacctgccgggaaggtgtggaggggcgagggtctctctcagggccacacacacggtccctgccctggtctttgcgggcagccgccagccctggctgtggtctgatgagtcagcctgcattagcgcctcattgaaatggatgggaacttgtcccgggctgctgggggaagctggccgctgtgtctgaggatggcttagggtactgccttggctggtagctgggaccacgcttgcccaagcccactgggccacgggctcttgtgccagtgctgacctcacacttgggtgccagggtgagaggccccgggatgccacctcctctccctgggaagcctggtcgttgtgatgagaagctgggctatgtggcggccacctcgaaggccaggtctggggaccctcccgcttgtgactcagcggctcagcttcttggttagtgaagaggggagaggccgtgtctggctcagccgcccctgccccagccgaggagcagccgatgggtgcggcctgttggtgctgctggggtgtgagactgcctggccgccggccgggtatggaggccggcacaggtgtgggggcacttttgcctctcccagaagccacagaagcaagggccctgggcctgagtccctgacacagaaaacccaggatgcccgttcagttatgtttggatttcagttaagtaagaatgtcttagggtgaggggtgtccatgcatgtttgagacgggcggcagtgtcgtcagttgcaggggtgcagtccaaggccccaggaatacccgaagcctcagatctgatgaaccctgtcctgtacgtactgttttttcttttcttttttgagacaaggtctcaccctgtcgcccaggctgagtgcagtggtgcagtcacccctcactgccacctcgatctcctggttcaggtgaccctcctgcctcagcctccccaggtgccaggattacaggtgtgagccaccacgccgggcctcatactctgttctctcagcctgataactgagatggctgctaagtggccatcaggtgggcagtggcctgcagcgtgggcacaggggcgatttggaccccgggcggtgccgagcgtggctacaccaggctcactgctgcacagaatggggcacagttaaaacctgggagtgaggcctttccgtcggagacccttcggatctcccttctgtgagatcttggccctcaagccccgcagaggggcctcctggggttctgtcggtggagctggggtctggtggtgctgccctcactggccgggctccggatatgctgcttggggtggagggcggctgtccacagccctggggtctggaggaggtgtgggtgagcccgtggccccgtttgggtttttgggggtgggtcgagtcgccccttttgctggtccctggcttggcagatgtgtgttttctccttgggtgcagcaggtggggcccctcggtccagcatgggctgacctcagggtgatttgtctccgtggggttctggggcgtgaaggacacctgtgcaggggtgggaacagtggcgctcacctgaccggggcaaggagggggctgatggggcaggaggagcggagaaggtgctggcatgtctgggcccgggagtgggtgggggtgcggcaggcaccagctgaccaccgtggcgcgattgctggggagacggggggaagagcagagagcacacgaggcacaggccccattggaggaacattctagaagccagatgtagcgtcacaggaatggcttcagcgggcctgggggcaaaggctcagaatcggcagacccagaccccagttggtgtgtttgaaagctgagcctgctggtcctcccgggccacgctctttcgtgacagcacagagtttttattttctaaccttccgtggaaatctgggtcactcaaataaggaggatgaggcctatggtctcagggagccgcgtgggccgagcccccgtcctgcgcactcacagccggggagctccaggtggagagagaggcgcctgggcccccctccccacctggcctccggtgcatctgggcatgggaattcaggcagcacaagccggcccggagctgaggcaccctcccttttccccgccaggcacagctgcgtccccccgaggccattgccaggtggctgcacgctggggtcacccctcctgaggatgtagaggggctgcctccctgcccccaccccggctcacagtgcgggtggctcccggctctcctgagttgtgctggccacctcacgttccccaccagatgaacccatcagcccatggtttcctttctccccaggaggtttggggctgggagctggttcctctgctccccttgggagaggggtgggtcctctggcccctgcttgggtggtgtgtggggcccggcccggccgtgtggggcaagagtggtgggcacaccggcccgtgcatcttttaattgtggtggctctttctgggctgaggtcccttctcggtcctcctcgtcctgttggcaccgtagggggacacattcccatttgtgacttggaattgggtgactctgagagctgacgccgagatttcttgtttgtgttttctcactcagactcagaggatggtgaggcctggggaaggggcaggcaggcctgagaggacagtgggtgttggggtgagggtgcctcttgcccctgggggcaggcagagtgtccacgagcaaatcctttgcgtccggagtggggtcttcactggctgctccatttgtctgcgtggggagcgggagacaggagctccctgtggctcagaccctgctcagctccgtggctccaggccaagtaacggtgccctgaatcccggcccctgccttcctctcagccctgcagaggaggccgcgcagcgtacaaggccctctggccagcccggcaccaactcattcctgttgttggtcttttcccagttttattgagaggtaatttatccaccacctaactcgccaatgaagggtccaattcggtcgttctccctgtatcctcgcggtggtgcagccccagcagcgatgggttccagaatgctttcctcgccccgagaggaaaccctgcagtcagctgtctcggcgtctcccgctggccttttccgtctccgaggttggcctgttctggacgttccctgtatatgggatcccacgtggtgtggactcctgcaccggcttctctcgagctttgtgcgggccggtcgtccatcctccccgcagagccctgacccttccacggttagatgcgccctcatgtagacgggctgcggtgtttatctcttcaccgctggtggatgtctgggccgtttcaccctttgctgctgttcatggcgctgccgggccgtccctgctccaggttcgggggaaaccctggcttcgtgtctcttggacgtaaatctgggagcaaaattgctgggtcaggcggaaacagtgttgagtcctcggaggaatggccaggctgttttccaaagcggtgcccacctgttgacccacctctcgcccccagcttttgggtccctgagtggtggttcagcagcagtgagtgctgacaaccacacccagccggagtccagggctgtgggagtggacacggcccttcctttcctcgccgaccctttggggcgtctcccatcgggaaatggcagcccctgacctgccccgtggggatgaaacgggctctttgcggggggcctgtggggtatgggcctcctgtcagcagcccgtcccggtgggtggggcttgccggccgcccgcgaatgtcaggaaccttggattcctgacacacgggtgcgggggcgatatcggcgcggagcgggcggggtggcgcccgggccgcgggtgggagaatctggcgtgtgtgtttgcacggcatccatccctccatccgtcctctggagaatttcaacacccacacttggaataaaaaaaaaaattattaatgagcttggtgcggttgccatgggaacctgttgctaatgaatctctggggtttcctgttacctttgccaagtcgaggaaggctggagccacactcctcaccgcggcggtgccactaatggggttgccgtggcaacgcctgtcactaatccccagctgctcctggttgaccggcccggcctgtgttacataaagcggtttggcccatgcaagccggctcctggctagggaccccgagacccctcctttgcttcctgaaaggagcccacccctccttcagggacacacccagacacgggaaacgggacacctggagctgtggcgctggtgtgtgcttagaaagtgcacctgcgaggttggggcgtggcctggccgtccgtccgcggggcccgggctgcccatggcagcaggtgctcagtaagcactcgccccaccagtgcgtggagcacgtggggcctcaggagccaggcctgttccccggggctgcctggaggcggccgcttgtccccaaggcctggtgaccgcacctctgtctgccctaggccttcgagttgggggacattttgtaaggagccgctgtgcctaggccagagatgttttcggaaggggtgcctgtaccccgagaggtggaccagaattcccctggggcacggtggcgggagaccagggcggcctctggtgcccccgccccctccagttggggcggttgatgtgggatccccccccccaagtgacagtttctgcccagctcaccccgatgagcccaccatgtccagtctgtttggacgctggccatccagcaacccccatctcctccctcctagggcctgaggcctgcagttcccaaagcaggaaggtctgaagctggtagagtccatgcagtccgaccacccaccccggggcgtggttctaggatggggccaacgatgtggggaggctcctgggcaggcggggaggctgctggacttgtgattgtggctcctgcttgggctgctctgggggaccctccagcttccctgccgggtgcccaggtcaccccagagctggggagatgcaccctggaggcagggagggctccctggaggtggtgacaggtggggtcgtggtggggaggttgatgatccagtgtgtctggtggtcctcagtgtcccccgagcccctcatgcatcgtgctcggccgagttggccctgtgtcaggagcctgctgggccccactcattgccctccagacccttccagagtcccagggcaccatgccccactctgggtgccttgtcctagggggatcatggcgccccccagccttgccctccaggcctctcctggagcctgaggcccgaggaggggtgaggctgtctgcatcgggtactccctcctcctcagcccgctccccactttaggggccgcagggggtgccccgctctgaagtaccctggcctgtgagcctctaggaggtgggctggggccgccccctgcccgcctggggtgagtctgcccacagtggagtcttagggtgatgccagggcgttctctgccagggttacgagtgcgtgggctcgggtgctccataagcatgcagccttggcaacaggagatggagggaggaaaggttctggactgttccagataccagaacgctgggtgtgcatcccagagcctgcctggcagcggccagtcttcctgcggcggggtgggggtgggggtgggggtggggcttgctgggggtcttagcctggaacgtggacgtggacgtggacgggcttcctttgccgctatgttcactgtgggcggcaccgtcgctggtggccgaatctgccccaaacagcacttggtgaagggctggcatcagatgatgcatgggctggcagaacccccgacctgccctcccaccctctgacacaggtgtcgtggactgggctggtgggttgggccccgagagggtggcaggggcattcgccttggtcctcgccagcatgcccgcggcccccgcgacgttcccccaagaagcagcagcagggcttggcgggcacagcgcgtgtctcgggttccccgtgggcagcgaccccaagctccagcctctcccaccgagagacacttcagagctgtgcgggccgtgctttcgcctccgcccatcagccggctcccgggctcccggtgcttccctcggagatcagggaggccccagcccacttgtctgggtcggccacaggccgctgggggcagctgacaccactgtggctgtgggagcttcaggccagccggctggtgcttgttcccaggaacgtttgtccgtctgcctcccaggcctggtccctggcccctggccccagggtgagcagggcccatctagagcccaggaccggcttccccgtgaggccggacatgggcgtgtgcgaccgcccagcactgcagtcacgctgggaagctcgggtttggagctgggcggctggggtgtttttctgagcgtttgaaatatggcctgcccacgggtcgggatcaaggatgttttaattcctaatttagactgtttatgtgcagggctcaagtcccggtgggaagagacagtgtgggctgagcccccctcccccgctcgcctctccagggcggcctcccggcttacagcgagctcccagcagctggggggtgcagggtctgcctgcaggtgtgccaggggaggggcctgacctctgcaccctgaccccagcccacccgggtgtgtcccaactgcagggttaccgaggctcagcccaccctgttcccactcagtgcagagccttctttgtgaggggcgggcccctccccacgccttcgggcctttccctgggttggggagctgaggtcgcaccatggctatggggcagcagggctccctgggacggagccagcgggacagggcccgaggaatccggggtaacactgggcagaagcagctgtcagcatggtttcccgtaaaagagactgggagagagacagaggcaggggaggggagcgggtggacgggaggagatggaccgtgaacagtgaaagacgtaccccgacaccggcctgcggacccccacaagcccagtggccgtcagccttgggattttggggttttccaactttaatcagggaatgtctgtctcccctgcatgagtgatctgtggagcctggtcggcatcctgattgtcatgccgaccgagtttgtggggccctcctcgtgcccccacgatctggacagggatttcggggtgagggaagctgggctgggttgggcccccccaccgccgtgtgcaggaggaagaggccaggagaccagggcatgatggggcagctccccactgcaccccttctttcctgtgggctgtgcaggttttctttttgttttgggtgctggccccggtcctgtgggtcagggttcaaggcgccaaccccgcattgtctgcttggctcagtggttcccgtgtggagggttggggtgcctggtctgggggccttctgctccccagggggacaggtacagccaggtgtcaggacagggcagatcctctctctagctctccccccaaccactgcacccatagcccgtccctccctcttcctgcacacccttggctccctgtcccactccacggccaggcctttgtccctgctgagcccctcccctcccctagtgccttcccacccgcacccctggggtgctctctggggagccctggaagtccctgccctgcccagctgtctgctcacccccgcgccgcccaggatcacctcctcgtggggaggtctctcgggcagcctgctctgtggggccctcctgggcgggctgggcgtctggggggatcgtggggctttggggctgtcagcagcccaggggggtaagaggacgaggcccagatgggccagtggccctggggacaggctttccttagaaagtcactgggttcccgggcagagaacccccgcagcccactttttggccctgggctctgaccacagagtctgcagagcctggagcccggaggaggcccgcgggaagcttctggaaa

SEQ ID NO: 437 - DNA, 8000 bp, Homo sapiens
  Locus number 49 genomic DNA region, homeobox protein Hox-A3 (Hox-1E)
tgcgttatcccccggctgggccgcggggcacctgtgcgctcccgctgcgccttgggccgggatgtctttgtttcttccgtgcacagcactcggcagcccctgcgccctcagcctgcctccgcagcagctgggaaccgggcagcccagctggcccgccgcacggcgttaccagagctgccgcagccgcctggagccccagccgccatcctgagaattcgccgagcttccaggcgaatagcctggccaggccccatgctggagccagagggctgctgcgtccggcctgctctgccggctcgcctcggcctgaattccacgcagacccacgtcttcggccaaagaaccccttcttaacacggatattattcagaataaaaactttatttctttttgtttctcagaatgtgagcagcaaggaatgaagaactctcaaaacaaatctagtatttttcgcgtttacagattttttttttcagttttgccggatgttacaaacctaaatcactgttttcaaaagctggatcttctctggttttattgtatcgttaccgtttaaaggaattatatttctctttcaaataaaaaaaattctaagtacgccaatacacaattgaacaaaaggcccaagaacccttctgaaccatcagggtacagaattctttaatataaatacgaacggatggggataaataatatttaaaacttagattattcaatgcttgcaaaaaaatataaataaatctgactgttcaccagcatacacacacggaaagacgtacacttagtcatccttgcacagagagcccctgtttcaaagcgcctttgattttttttctcactctttacaagaagtgcaattaaaaaaaaaatttaaaattaaaaaaagtaatcgcttcccctcgggagccataatgtaagaacaaattcacattgaaaactcgactagaaaatttgttcatataccctgtttctgatcaaagagtggagaaggtaaagggtgcagggccagtggcctatcgaggagcaggaagagataaatatcgctatgatacagccattccagcaaccaagattgctacgtcacataaactataaaaacgccttaccaacgaggggggaaaccgggaaacggagtgcggggcggagaagagagaaaaggaaggaaggaaagggcaggaagaacctaaaaaaaaaaaaaaaaaaaagcaaccaaagaaaaaaggtgggtggggggagactctcctggcgcgtagccccaagcccactatcacaggtgggtgagcttgggtgcttcctgaattcttccctgagaaggatggtggccggtaaggtccgtgtaggtggggtgcggctccccaggccccggcccgtggtggtggccgctgcccagcggcccggcacccccatagtccatggcgcccgaggcagcgtgggggaggtgagttagaccaaagagggctggcccggagttgctcatgggctccacatagctgccccccacgaagacggggcttccctgtatgtgtggggtcccatagctgccgttgccctgcaggccatgagcgtgcgggtcatagtcgggggtgccccctgcgcccgcccctgccgccgtgtagcgcttctgtgggggtggcgggggtgcgcagctgggcagggacgcagggtaggaggcggggggcagcccgtaggtaccctgggggggcttggagaagggcgggggcgactggggctcatacgggacgctgttgaccagcgaatgcatagagttcagatagccaccggctccggggggcacggggctgcgacttggagactggccccccgatgacgttagcatgcccttgcccttctgatcctttttgtacttcatgcggcgattctggaaccagatcttgatctggcgctcagtgaggttcagcagattggccatctccacccggcgcggccggcacaggtagcggttgaagtggaactctttctccagctccaccagctgcgcgctcgtgtaggccgtgcgcgcgcgcttggacgaagcctgccccggcgggctcttgtcgccagcgcagctttcgcctgcgaggacagagagaggaagagcggcgtcaggggctgccgcggccccgcccagcccctgacccagcccggcccctccttccaccaggccccaaaggttcctgcatccgtcaggtcccagagagaagtaggaactaggtgctatcctctctcctggtgggtaaaacagtgatactccctcatttagccaaggagcaaatcacagccttctcgggggaaaggacagagaagtagaacccccggtttgccttcctggtctggattttctgtttagagctattaactttctgactcatttactggtccctttggcctatcggacaacagcctccctgtgggccggtctcagcatctccattctcttcacagtaactgaaatgtgggaaacctaatgtacacactcatttccctcccacactgtctgacaataattaggcagtagcttcaactggccacttttttctctctacccagaggagatgggcagactggaaacctcaaactggaaggccttctctgcccaaagaagagatcccattgaaggtatttctggtggggaggcctaggcccttcatgctaggtcctattctttagggttccctatgtcatcaagcagccagccccagcttttgtccactaatcttgtacccttctgtcttccctggccccccagatcctagctctggaagtcccagatgctcaggctcagagcagggcactggcaactggagaaggcaggggcaaaggtaaccaaaatgctaggaagcctaaagcctggggcctttcctctactggagcccgctttcaggaggcccatgtggttcccattaggatgataagtctgcatccccctcccccaggagatctttggctgctttcattgtactaagtctgagtagggtcttcccagaggtaaggcagccactccatctgctggagcaaaaattggctctgattataggcaaagcattgattctgtcttggagggtgattaggcctgtttttattctgccacatttcagtaaggggaggatgtcactgtttcattagaagagctgtgctaaaaagatagacagtggagctcaggttgtttctgcacagaggtcctaactccaagagtggagcaagaagagattccaactgcactagaccctacttgcccttggagaagtccagagggactcccagcaggtctctggtgttttccagcctacagaggcctatcacctccctaagttgcaaagactatgaaaacctttttggtgggcagtggtgtgggagcagtgaattccagacatgctccatcgctcctaggctgtgctggatgtcgtgggcagtagcttggggaccaggagccaggccagaggaccctcttccagaaggcactcctttacctgagctggagctgctggttttctgctttgtgttttgtcgagactctttcatccaggggaagatttgtttggccactgtgggtgagttgagcagggggctcttggccgcgttggcaggggtagggttgttgctggcattctgaggaggggaggcagaagagggaggcgggggcgcggcaggggtaggtgcagggggctgaggtgcgggctgaggcggctgtggggcagggggcgcggcctggggcggcggcgggtgcaggggcggctctcccaggcttggaggctggctaggtggggcgctcagggtgcgcaggcacgcctcactcagttcgtgtgccttggggtggcccccggcgctggagggagactggagggagcaggcgggtcggtggtactcgccgtcggcgcccaaagcggcggacgccgggtacggctgctgattggcattataagcgaacccgttggctgcctggtaggggtagccaccgtagatcgccgagctgtcgtagtaggtcgctttttgcatcgcgttgtttcacgatcttgatcgcacactctgacaggggtttgacacccgtgagggcgcacattggcacgcccccgcggtcacgtgacactccgccgccaatggccgccccgcgcagacctggtggggcgagaagcgcagcgcggtgagggctccgcgcaaatccatcttactctcaatagctaagtgacatgaaagccataaaagaaaaagtggtcagcaatatttagcagcacgacttggccccgggcgcagggagccgtgctataaaaaaccgctggaatttactggcagctacaaatatttgcttaacttgcgtctggagttgggggattttccggggagaaggagaatgagtgagggctgcaagctgattctcaggagccgggatccaaaaggagaaaggcttgataggctagaaaggaaaaaggctgggatctttcttttccagggaagaagaaacttggggtgtcgcttagtttctgctccttggcctcctccagagggcccaagactcctccactctgggaatgttgggaagggaacgaggaggcaaaggggagcttgggtcgccaatgttttctccgctttaggactgatgtttgccaaaagagccctgagatggggtaacttcccacccagctccttcttggaccttcctgctcccaagagaggtttgcacaaaaaatttcaggcaatttgccccatccaaccatgctggatttcagaagctgagcttgttaggaagttaatccaccttgttggggatatgactcacctcctccaaatgaaccccttgtggccaagccaaggggggagggaaaactttgtgtggaacacattgcgtgtgtgtgtgtgtgtgtgtgtgtgtgtttagggtgagggaccaacagtaacaccccacccagcaagtcacaactaaaatcctggagagttctttactcctttcctctccctgtttctcaggcacttcccagcaagccacccccacttctttacttctttcccccagttacagaaggttcccagaacctcctgtcttggactttctaaggtgctgttattcggggcaactatcaaattctacctgttaaaacatgatggattagagggggaaaaaaaacccctccaggaacctgaaaaaccagcgttcatctccatgaccacagtttgaactctccttccaacttaacgataataggttctgtcttagaaactgctatgtaatttgatgtatgggggtcatttggctcccgacgagggatggaagcacaagccataaaatcctgccagagtttcctgatctttgtgtgctgttgttgttgttgatattttgttacttggcctatttacctgcttcagaaataccaagtaaaggataaccctgaaaatctaaaaagcagttgaaaacctcctcaaccctctttcatttagaaagcagtttgcaaaagttaaatctgttttctttttgttttcaaccactgcatggtcaacctctagttctcagcacagaaaagttccatgtgagtttcaaatattcacccacacacacactcagaatcttagtccctctgaccactcaagaaaattataacaaattcaaaagaaaatggttaacatgcaatccaactatgtatattgagtcccagagttattcaagttttccaggaatattagatgctttgttaactagaaaaaaaaagataatgtattgcatctaccagtagatgattataattccattgttgataatggactcctttagatttcattattaagccaacaatcttaccaacatctgcaaaacaggcacaattaattttccagaacctcgattaaaaattacagcatcgcttatccagagttattgtcagtgatcatgagccctggagcattgtttctcttttggaaataggaagctacacataccatggttgaaagtaaataaaggataaagtaaaacttaaaactgaatagcaatttagtgtatccgtttccttttcttttactgaaaacagttcctattacatttggcagtgtcaatgtctgccattacaaattttttagataccaggcttgtgtaaaataaaatgtcaggttaagaaaattagacactcgaacagcaagatattagataaaacaaaattaagctgattttgcacatgcaatatttctagtgacttgctaatccattatcacgttataccagcctgctacttagttaagcctttttatcaagttgtgcattgtcttacaaaataacaaaaatatctttgaaaatcaaagagcatacaacagccctcgtaaacttaaaatataaattcgattctgggatcccaccaaaatccttcctattgttcgaggtcagcagaccaccaccttggagctcatacatccccccaccccaacccagcccccaaagtttgcaacctagtaaagaagttggagatttgccagccaggaaactttgctctgtaccgccaagcaagggctggggatgaggggagattcctccacaaagatctgtttctggacaataatccccaggtgcaagagccgaaagagagttgaagaggctaaattgagtgcaagaagcaagccctattgtctctctggaagatgtgcccaaattcaacctccgtccttcagacatcgctccctcttcccattccctcctctttcttagccttccctcaccccaaatctgagcgggttcgtcggataggagccccgagtcccctgcccacctctccttccctctgcaacccagaaaagttaaggctgggctaggggagaggcaagaggtgggggcggggatgggaaagcggcctgaactcgaagtgtaagggtatcagtcactgccgggaaggaagctccggcttgtgaactcttcttgaaccgagatttaagtctgcagccataaatcaccgagacgtaaactccgccattcagcgccgggagcggccggttgcggccctgcttaccttaacttctgacgagcgcaggctcgggctcaggctccgacacgggctctggcccccggcctggcttggcggcccggccgggtcccctcggcgcgggatgggcacggaccctcagcatcagccgagatggcaggcgggctggagaccccgaggcccggtcaccgccgcgcagagcgtggccgcctcgctgctccagcacggctcgcccagggccgactggggcggcttggacccccctcccacccaccccacccacccacccctcccccacacccccgccccctgcccttcccgagggcagcagccgcggcccggagataagcgctagtgcggcgccgggctctgcctgggctagtggcaccgacttgggtatgtttcttatgaatattacacgcggagcagcgtctggtccgggggtgcggtggggggtgttggggcgggcgggaggggagaccaaggcggctggggaagcgcgggctggtgtgggggatggggctgaggcgaggggagggaccggagggagaaggggagctcggcggtggcgggaggagggcagcctccccccaccccccaacgccctccctctcctgctcccaggcgtcacgaaagtccaggaaaattatgctaatgaggacaaacggctctcacaaaggggctctcttgctgggctctatttcttaggaattcgtttgagaaacttcgtattcctctgccctggacacttccaattgtggggtgaggggaaagagaaccaagaaaagtgagtttcccagactttgcccagtttacttcacctgcaactcccaaacagatctttgggtgggggtgtggggagctgggataaggcttttctctagagaccctcaagagccaactgggctctctttggttaaattttcaggcagaaactgctgacatcctagcagccaggagaaaaatgtcctgggagagacaggtacttgttccagcagtgaaatgggatgctctgggctcaggtacaaacaagggtgtttagaaacgcgg

SEQ ID NO: 438 - DNA, 8000 bp, Homo sapiens
  Locus number 50 genomic DNA region, Feature name ha1g_01966
cttaagaactgttggtaaaatagattatttttctgccaagcataatttttaatgtccttctccacctggacctcgatatttactttttatttgcacatatttcctgttctatgcacagattcttggttatgaaaattcaatattaatgccactaattttatatttttaaatgcatttctcagaagtaaaatattattaatagtctgagaacttttctgagaagtggtttggagttatttgtttaatcatcaaatttaacagctctcaataatataataaaaatttgccctcatgggcatccctgacagcaaagaaaataatttccttataataaaactgatcccaaggatgtttatatgctataatttatctcatactaaaagatggctagaaaattatataagatagatttacagtcgctccttcaactcagaaaatttatatgtctagtttttagtgacttaaaaacttctacttatctgcataattatatataaagagattccccagtagcttttatgtcctatgattcaacataatgagatcaattatattcagggaatttaaattactggtacttagggaataaaaccaacatcacttttagtttcttatgatggtatacaagaaattctacttacctaagacaaaataaccatcttaatgcagcccattttatgtgttttagcagagattttaaaaggccactaagagtttttgtcatttaagaaaccgtatactcagttccttaatgtcttcagatgttaatttaagtctgttctgatcttgtttcctacagttagtcttttgttccaaaatgatttttttaaaaaatgcttgagtaattttgttagtatttgccactagtctagaaaaattaactgaaattcttgcactccatttttaaccactccaattccctattaaatacacctacaaattaaataaggatactgctgctcgataatttaccattaaatgagtgtagaatatttgactgattattttactaatttcttatatgtgaaaattcttaaaatggtggaatcatttgactaattgaatgcaaatattaaataatttttttattgatgacatgcatgctgataggcacatcatttgatgcatcagctaatgccttgtcaggtttgtattctcttttttatctgaggctgggcacatgggcattttaactcaggaagtcttactttctctgccttccctaaaatcagtgcctacatttgaccctgtggaaaaacacaaaagcgagtaatttaaatcagcccacacctgcaccatcagccaggctatccttacagaaacgcttcgaacatcttattccggagcacctcaagcggctgaaaagaacaatttattccccgctaaagaacaaaatactgacattgagtttgtcttctttggggttggaggaaagttgagatactactcatgaaaaggcagctatgtttggccctgtggtgatttagatttactatacaaaccaacaactatttttgaatgatggaattaagtatttacacaaggagacttagctctttagcttggttatgtcctgctgtttatgttacatgatcagaaatcttgtgagtgctgttttaggtgatacatcaccaagaattcttacattaggaaagtaaccatattatctgagatcgtttgctgtagggaaacctgcagcaaattttgcactagctaaatttgtttagctaaattttgcactttacaaaataatagaaaaattcattcgactctcccctcaatgtatagcatggtcgtctcatcaccttgcagtttgtctcatatgcttgtgttgagctcttttaacaggacttccaccaataaattcaagtttttattcttgtttataaccggcatttccaggtccggccaggtccaaaaaaaaaaaaaaggaattgagggtttgcatcgtttttcaatataactggaagctgttttatcactttgtattttgagaaccgctccctttcccgcacacgcattgctgcctcctctcgggcttggttaatgagtctgtgcgccaagccaggtcgctccgggcagttcgcgcttccgcgcctcggcactcggatgaccgtgtcctattcgtctctctcgtgaatgtcgctgaaaaaaaataaaagtttgttctaagcccgtggcatttccgcgcgcagatggaaaggcaagtgggagaggagggtgcaggtgcggggcgggcgcggcggccccttcaggcgccgggggctgggctgcccccggccgggagcagctccgctccgcgcacgtggctgtgggcgctgcggacgggggacggcaggcgggggacggcaggcggggagtggagggtgcagtgcccgcaggtgccgacggcttcctcccagagcccttcgcgccgcgccttgcctggctggtggcgcggggaaaccatggcagcattgcggctccggcgggcgggctctgcgcggggccccaccgagctttccgggagcctctcccgcagccgatgggcatctaggggcgcagaacgaagagtgggcgccgaaacgggtgtaggcgctggaggccgacggggaggcccggggcggtcaggcttctcggtagagagggccgtgcacctcgcggcctgcgggctaaggcggggagccgctcctgcggcggccgggcgcgcggactggagggagggaagcgccacggactggggaaccggggtgacggggagacgggggggctggtggggtgaggtcggcgggcagcagccaagtgttctgcagctccgaaccccgccaccctctgggcgaacggaatggcacccgcggagacgggcggggacgggcgaaagcgggtttgctccgacccgaagctgagcccgggttggagggcgagaccgtaggcgagaatggccgcgcgggctgggagacccgggccggtatggagtgagtggagccgcccgaggtagggtagttggggatggtagttgtgaagacagtcggagtctagctccgggcagacgaaacaccggggcgcgccagggtccgtttcctccttctctctgctttcccaccagccctgtagatacggagccagcagtcgggctagagcggaggctgagggtcgcggttccaagggcggtctctcgccccgggtcaggccccaccccgcggtggcggtcgcgtggcgctgtcctggagttgagctgtccccgcgccgcggcccgcacgcccaggaccgcacaccgccgcccgcaggcagagacgcctgcaacctcgccctctcgcccggctcccagctcggggctgggaaccggaaaggtgcatttccgtgtggggtgggggcgattcccggctgtcggcggtggggctaggccttgcggcggatgagccagaccttcccggctttccagccagccgggttcgggatttcccgacggtcggacgggtggaggcgaggatgggccgctatcccccagcctcttcaggaagaagccgtagggccaaggaagggatgggtgacggggctcacaccattccagcgctgccctcgaactcgcgggcctccgttccctttgcagtcacttggtgtgcgccccagtcccgggcaacattactgcccgcgggcgccttgtgtgcatggctgctgcctgcggcgcaccggcctgagcctggagggaggtgcggggcgggagaggcggccctccctgggtctcccctgcctgtcacatctgcacttatttaaagctcggctggtggtccgcgctctctggaatgccagttgcgggcctggcctcctacggcatttgcactgattagctagcgggtcatgggggagatgaggggcttaggggggcagaccggaggttcacagtattccgcctgcctctgtcccgcgtgctaatcggagcccagtgattcccgctgcaccaatggctgagtgtgttagggagcagaaaaccgaacttgaaggatgttggatgcgtctgggaaccggccattgccacttagtagtatgttgtgggccggcgcgcacacatgaccctaaatctctgcaggctctagcgctgaagcgggcggagaaggggaacaagtgctgtgaccccaagtcctaaaagtttgtacgcagtgtctgggatatgcagtatccttgatgcgaaactcttaaatgtttgctggtgcaagtccatacaaaacgaggttggcctgcctcgcttaaaataccgtacacaaagcgtaaaaaaggcacgggcaatccgcatcgaggacgccaccccaagcgcaagaggcccggtgcaaattcatcgctgaaaaacaagctgggttctaatttactgtgactcccacgggcgcaggggttgggaggagaagcaaagggggacatttttttatttttgaagcctcaaaaagttcgatctgattttgcatttgcctttggacttggtataattaagggtgaaaataaggcccctctgtatttctattcccctttgcttttctgcggagcttttacctcagaggaaagttgttttagtaatctgggaaagagaaaccatgtgctgagtcagcaaaaacgcggcaccaggccagttcagctcaattatactgctgtgtgtaatgtacacactctatatgcctttgtggaaataatgaaaaatatattagaattctcatggcatagcaatgcccacgaagcctgttggcagttgagagccagatttccgtgtcttctaatacaaggaaacaggttctgaacatgtcttctaacaagccttagatccaaggccacttaatgtgagaggacaagaaaaatgcagttctcaaaacaacacaaaatattttacttttttttcaaatggtcgtgttacagaatgcttaaatactcctttctgcttgtgttcttctgacaagtgttcaaggtggctccaacagatggaatcttaatttttattttgcatcattaaatgcatttctcaaaactgattcttgaaaaggtctgaaaagtctccttgcaagtcccgttagaaccttgaccatgcattctcatttgtgtggaaggaataaatgttttcagagtcacttggaatgaaactctcttaaactactaagcaattatttttcggaataattgcttttaactgtccaagtgttacctgaatttgcagtatgtgaacatttcagctgttaagcaacagtctaaattgtgctttttaatgacacacattcagtatttctggggatatttcttcatagttattttaattctaagagtttagttgcagaaagtgacttttgaaaaacaaaaatagcatattacataaagaactaaccagaagtttgcctcagtttcatttgtcttttctacctcaaaatgtgaaattagtacatcttttatgcttttactatttaaagtcttaaaaatatatagttgtgtttcagtataatgcagaaatatctggatgtgaaaaattcagtctgtcacccaacttccagatgtttggtactacgcagacaaaacatcagaatgaatgaccaaatttttttctctacaatccagatggcttagtgcctcttgcttctataaggaagcatattttcctttctctaaacatcacatcctactgtagcccacataaggcatgatttacactccttcagctacaaaatgttaggccatttggagtgcagcaaagcaatcagttaatgaaactatatgttttggtgaatgtagtccaagtccaagtgttagtgtgtacttaggagggagtggtggtggtggagtcagaaatgggaaggtaggagagtgagcgccttgttcaatgggagaataacttggctaaaaggacacagccttccaaaaatccatctgtgccatccataatcgtaataggtgaagtggaacatttagcagcttcaacagggctgccttttgcctgagatgcagctggactgtgaaatgtccatcgtgtactgtgaagctttctttccctactgttccttcttggagcattataaaatggaacagatgaatgtaatgtaacattataacattaggactcatgaacattatacaggtggaaaaattctctgttttaaaagtaaaaaggcaagtaagtgatttaaatattcatattgttatatggtgaatatttaagtcactcaaaaatgtagtgatgatgaatggatttctcttcctatgacatgtcaccgcattttacagttgttgaacttggggctgaagacagcaacattttttccttccccaaagtcaaagagatttaagatcatgaacagagagccagagtttctctgcttaaacatgttgagaaagaaggaatagatataaagagacttccactagaatcagcagatgaaatcaaacccagaatgaattccattctatttattaacctcacactccctggattatagaacagtgtttagataatgaatggcaatgaatgttaaaacatcataaaacctgaccacttaacaatcgctgcaagaaaaacataccattttaaatagaccttcttacaactcagaatctgggccttggataataagacaggattttatactggcccaaggtcaattttaaagaatagtttatgggaatctagtagaaccttggggtacatatactgagtaaagagactcaaaagtcaagtgggaatctttaacaccatataaaacagaatcacagttacttttcttgattggatgttttcacgacttttttggtaattcatttattagaataataaactgacagagctggaatggacttagagctcatccaggtctctgtctttatagatgaggaaatggaaccaaaatgaaaggacctatctaaggccacacagtcattacaagaagggtcagaactagaatcacagagttctaattgtgagtcacagagtccagccctgtctccaggacagcttgcctttgaatcactatgacgtggctcagcgttacagatttcctagtggtgtccaagaaactgacacccatcactgcaggctggaaatggctcaacatcattcatttgtattacacatctaagagctataaaacaaacccagtgtgaaggcaaagtttccccatttgtctccagaataagacagactattgcaaaaacagagctaataaaactctgtcaacttcaacaacttggttagaggtcctgataacaagtgacagccttagctttttacagacaacttatagtgccttggaagcatgtcatgtgcagaatccgctacagtgtctttgaaaatagcacagtcaaacattcaaaatttaagtgacgttaatggggaagagaggaggaggtggtggttatagccatgtctacactactctttacagaagacatagatgtcagtggtccttcactcgtctcagaaaacaactcacgactacagcagcttgcatgatgaaatggaaggttaggatgcaaggggaaggtggagggtggaagatggggttggtgggtcatattagatagcaatatgaagcatactgttccccagttttgaggaactggggatctcactagttctcatggtgtgagccaaggaaatagactcttatgtgatgttatcaaagcttttctgtttaatgttttattcaacatcaaatgagaacatagaagcattgcttctaggaagggaagacaacccctgactcctacacgagtattctgctccaggaattgcaaggaagtttaaggattaggagagatgggggtagaaggaatgggtgaagtcaggactcagtatggttggccctctatatctgtgggttccgtatctgtggattcaaccaacctcggatggaaactattcagaaaaaaaaaaaaaggatggtttcatctgtactgaacgcatcataggcttttctttcttgtcattattctctaagaaatacagtataacaactatttacaaagcatttacattgtattaggtattataagtaatctag

SEQ ID NO: 439 - DNA, 8000 bp, Homo sapiens
  Locus number 51 genomic DNA region, Feature name ha1g_02153
ttcttcaaatatccactttttttttggagggggagacggggagcagatgcctcaaagggggtcaaagagaggggaaggaaattgcacataaataaaccggatgattccaaatgcaaggagtcctcagagcggagcgcggacggcttttccggagtcctgggtctgcatctggcgccttggcccctgctcactcgcgctctcctcctcctccttctcctcctcctcactgcttgagctccagggcccagacgtgctgcggccagcccgtccggcctttggttttcttgtcgttgctgctcactgtgcttttcaagatttcgttctggacagaggaaaggcgagggcgagaaaagtggaaagagaaattcagagaggatacctggttccacaccaacccggagcttcctgcgccggaggagacagtgaaccagagaggaaaggatacgatgggggagtcccagcccctgcagagaagctaccaaggttagcgctaccctagccggcggggaggcctcggcgctgcagcgctcaacaaccggatccacaagtttataaacaaccgcccgttttcgagtcgtttatggaggagcggggggccttttctcttactccagatgtaggggcgggagctggagtcggcgctaagtctggtttctctgttttcattagcaatcctagatccacatctaggaaaaatagggcgaaggagcctctgtttcggcctgggcctctcggccagaggctctcggcctccagctcagcagtgcctctcctccaaggcttctgaaatctctggttattcgggaggtcactcgattatgcagccaccaaagggctgcaggggccaaagaagaaaaattcgacaaatgcaattattttccgggcccttcgtggacatagctctatcctgcaccactgccctgtgggcacttggtaggaatctgagaaaattttaagcggctcaatttactttcgtgttatttttaataacaatgaccatagtaatgccttttcccccttaaaatgtacaggcttattcaaataaaattagaaatgccaatggaatatactcatctgggaaattacattttaacgtcatagccaaggaaaaattggagctgtattttgaagtcaaaagtacttattttatgtttaccattacgttttccgggcatagtatgagaacaaccacaaaactcagggctcagtctctggcagcctccttctgggagtggggtagggggtgcgatcaatagtgaaataattggaatcaagggcttcttcgagacttattctggaaacatctgaaagcaagattggattggaggccaaaagaagggtctaacagagacggggtgaggcatccagaccagtgcgatcgcgatcgatcgcgacccagagttttcaaggtccgtcctaagtactaggggagcagcgataacccggaggtaagatcaccagcgcaaagcatccctaaccttctcctcctcctgctgacaccctcccctcaactctctgcttatgccggaagccatccttacacaacctggtgcaaacaaccttgaagcgggacgcagccaaagaacacgagatgccatttctcagcccaattggaaagaggccgggagcaccagttccctgaccccctcagccccaccgcctgccgccccctggtactgaccagctccttcttcctcttctcctctttcacgtcggtcttcttgatctctgccttgaaggcctccgcctcgccattctggtcgtccttggccagcaggtccatgaggtaggcgatgtagctggtggccaggcgcagggtcttgattttggagagtttggtgtcggcgggtacgttggggatgcactcgcgcagttcggcgaaggcgctgttgatgctctgagtcctgcgccgctccttgcggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccatggaagtaggggttctcctcatggctgcagcggctggcggcggcggcggcagctgcggcggcggcggcggcaaacgggtagccctcgtggtgcaccaccgggtggtggggaaaaccacctaccagactcatttcgccctccgcgcccctccacgcgccccagcgtgcgcgcagccccgccgcgccctcggcccgggcccctgcctcagcgctcggcgtcctcccccaccccccaccccccagcccccgggcgcccgggcccgcccggcagccgcagagggggctgctgcagcccgggccccgtccccccgcctggccagccgggcccgcctcagcagcgctgcggccgccggctccccatggggcgcggcgagctggtcctggcaccgtgcgcccctggccgccgccgccgccgcctccggttcccgccttgctccacggcccgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcggctggaggagccggtccagctgtgccggggggcggcggggtcgactgctcactgcaaagctacctccgtgcgaccctccccttcccgcctcttcccctccccccaccagcccgatctgggttcttgggcgcttattgttttaatgaaatttttggttgttgttgttttggtccttaaatgtgattttagctgcgagtaacgtgtcctcgctcctctcgcgctctctcggagggttttcagagaggtctcagtgcatccattttctcagatcctctcctttcggggcaaggatctggggccctgaatgagccttggagctcgaagaccgcggctcgggctctcggagggctctgcgcggtggccgaggaagctccggggtgacggcggtggttctcctgggctggacgacgtgaggggagcaagcggattttcccagcaagatctccatgtacagctacatctttagggccgctcgggttaatatatgtcgtcagaggctcctcacgccaatcccggggcggcaggggcggcgcctcgagctctcggcaataaaactttttgatgttcacgttgctaattgccgaggtcctcttccaggattggctacctcctcataaccataagataattaaaacttggcggggggggggggcagggttaaaaaaactttttttatcagtcagaggataatgcaagtgtttaacagatgcttcactattaaaatattttccccccaagtctcaaatattgaagaatctctaaccaggtacagtatcactctgctctcttttctggttgaaaagaaagaaagaaagaaaacgcaggtattgcttttcgaagtgctttgtaggtaatcgaggtaagaaaatatacgcaggcagcctcttacaattttatgcaggggcgccgggagcctcgtgacgggcggtgggggcccccacaaaggcgcggctgggagctggcgctctttgccccagcagggacgaggagcggctggagaagggtgtttctttgacccgtttacaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattccccgaatctgtagtgtggctggtatcggtgttcccctggtttaactagcctgtttggtaagtaactgaatattttttacggcgtgttcagagcttattttccagtttttatgaacaaacatataaatatatctctgcattcctgcctccctcataaaagcgggcatctgtggaaagcaggtttagttatcggaggggaaccattaaacgccagtttaagaggcaggccgggaggacggctcgtggatgttgagactgctggccttggtgatcttgaacgcattataacggaaaatggatctccacttgtaagtcaccgggccgcggggcacccgggccgcagcgcccgtgtggcatgagcttcttgagaaggctcacgtgcggcgagggcgggtggtaaatggcaggagctgaaatcaccccaggcttggccccaagccgagaggggaggctgatgtgtatatgcagattccacccgaaggagttcggtgtggaaaacggtgtcaacaggagcccgcgggctgtaaattagagggaggcgagggcctgcggcgccagcgcgggacagggcggcctggggctcgccgctggtcaggccaggttagcccaagggagaccaaagactccaccttgagcatcgccctttggaggcgggcagagtccggccgcaggccacaaagcgatccccacccgaaggactccacaaggacagtcctttccttgctcaccgccgacaaagtggttggggcaggaaggcgaggtcagtgcgaatggagggcgcccaacttcggtgttgcagttgactctgtgctcgggctctgccctccactagccctagagtcttgggcagcaggattgagaaatatatatatttcaggtttgccgcggctgggcggtaggagacagggacttaaaagcccaggattagagtcggtgcagggcccattctttttctaggaaaggggttaacatccttgaacgtccccagacaagcgtcttaaagcattgaacctagaatagggattaactgaaactaggctcgttggtaagcgccaggggcttgcagttgagctcggaacaaaatagtgacctactgctctaaacccccaacttgcgtgggtctgcaattttttagcacaaggagagccttttaaagacctggttcttcaaggaaagaatgcaggtagtgtggttgggggttctgtttacattttcacccggaggcaaaccccgaatgtgtaaatactggtagttcaattctctgacatttgatacgtttttgaaaagtctgtttataaaaacacatttaggccttgggagcaggtagacaaagtaagattgcactggggctgggaacatataaaaattcagggaaattagttggttggctgctttaagacccaaagggagttttgggaattgaagggaggaagaagagtccagaggagggctgagttagggattgagatgctctgtccaccagagaccagcggtgagtggcctcacttttgaaagcttcagaacttgccacatttagcttttctcatgcttttaattgaaacaaacaaacaaacaaaaatgaatgaattacctcgtggctccagatagcattgcaagtggtaaaggaaatggacaacatggtacagaaaaaagaaatcataaaagatgctaatctgaacatcagttctcactcacagtgtcattatcagttaactgctgtggtccaagggcctaagacttgatgtggctcagaaacccaaatccagaggtcactgccttagaaagctggcttgatgagaggggacaaatggatgaaccctagtggtgtccccaactgtagtaactgactcagggaggccaggctggccctgactggttgagctctaccctaaatgcacaaacgcatccacttttctcttgcagtgtcctttggcctgttttgttccaggttttccaggatactgggttagcctgctcctttgggaagttgtgaagcaaggatgccatctcaagtttgccctcaatttaggtgtcctgggcatcctggtggtagtgatggaggtgttggcagtggtggcaatgaaggagagggtggtgttggtgatgagagggaaagtgggagaagaaagggagaaaggcacagtccctgacatcgatgtcagcatggggaccccactcctgggctgcactagtgtagctgctgatgcacatgttgtaagtactcaaaggcccagggaactggcttgctgggggctcctctgggtgcctgtggaggaatcttagctaggagtgcttctctgcctctcctcagaggctgagggctgagccaaaaccggccttactcgtgtccagaaactgcttcacaaggaggcagcccaggtttgggtgagtgtttgggattctgtacctttgttgtagctgatggtgtacctactgtactgcacatgtcaactgccttcagccaaatagacagaatctggttcaagcatttattttgctcctcatgtctcttgtctctttgccgtcactgctacttctttctctggaaaaagacggaaagagcagcagagaggctgaacatggccatgcaaacattttggtcttgtgagatattattatacttgaaaaaatcaatctggtttaaactaattttaaaaaaatctttagttaggttttagggaaaatacagattgtctcagggtgtttattatttcaaaggcaagggcagtttatatcctctgttttgctcataagaacccaaaataaactggacccaaaaagaatcaggccagagggtcataaatgcacattttatgttcatgggaattatggctcaattctcatcatcgtctttcaaatcttgtttcaccttgtttttctaaccaacatagtggaagtgactctgaccgttcccttaagaatctttaatgctcttacatgagatgagcctcagaacaagctaagaaccatcgaaagaacatcaagcctggaaggtgacagaaggagcaatgtgttcttgaagatgtcacctcagcccacctgctccaaggacagtgcttcttgcgacactctgatagctctgcattcttttctgtaccagggtagggtggagtcattttacatgctatccacttagtcccaggatgtttaggatgctcagaacaaggcatattgtctgagtggtggcaagggtctccctctaactggggttgtgtagtccttcctgtttgtgtagttcttcttgtatagtcttttcttgttggcctttgagaagtagttgtctacagacataccaagtgaaagtggctccagaagtgtcgtgctgctcaaagtacacatctgcaaagcagaatcaaattttgttggatttgagtgtctatttcaaaaaaggaagaataagaaaagctgcccttgtgtcttgtgaggtttttttttttcttcttcttcttttaagcaagttttttcctcttcttttaagcaagtttttggttaagggggtggcatatttaggggttggatcctcttcctttctcttccctacatggagagatggagggggaggggctagttcagctgaatgatgacagtggaggggctgattgcttatgaatccttcagtccagctctaattagaaaacagttaagttggtggagaaaatcagggcttgcttagtgcctgcacattccctcctcctctttctcctctccctctttcccttctttcttccttccacccccctccctccctctctctcttcttctctccagttctcccttgtaatttgccgtctagcagcatttgggattacaaggttttttttcttttcttttctttttttccctatcactgaatctgcaactggcatggaagaatgagatactgattcatgctgaagtcttttaagaaaaatcttaatatccacagtcagtagaattttcctttctttctaaataatcaatgactagatcctcatgttaactggtagatatgttgctgcactggagggttttcattgataaggaagaactaaa

SEQ ID NO: 440 - DNA, 8000 bp, Homo sapiens
  Locus number 52 genomic DNA region, homeobox protein EMX1, empty spiracles homolog 1, empty spiracles- like protein 1
ggagctgcttccagccccgcgaacagctggagggtggcagtgggaccgctccggcggcttctcccgcgcagtgccccgcctggccccttgtgaagggagtgagcgtcccctttccagagctgtcccccgtgacatccagaaaacgcgaaacctcaggaacaaggtcgcagcttcagaccgcggcccaggaggccgatggtgggtgagtgggagagtcccggagagcaggggggcagagagctggttttcgggaaaaccaatgtgttggaccccaaacatccaccctccgctcggatccaagttctctgagaactgaaacgacatcccgggacgaatgggagagttaggctgagctacacaccggggaggggagggttggagtttagccccaagcccttcggacgccttcttcggctcccgcgtgggttgagacggcggcacggccaccagactcagctaaagggcggagtcgcgaggagaagccagtggcgaggggaggaggaggcctggatctccccgcgaaggctccagtccggcttttgcctccgactgcgggctccctccccacccgccgtccctcgccccgccccgccccgccccccaccttggggcaggtgagcggcggccaatgggcgagcgcggggcaggtgcccgctaactcgcgcctcgcagcgctgggcggccggggctgggcagggcagtgcggggacaccgggggctggggtcggtcccagcgggactccgaaaggagggagacgagctcaaccctcgggccttactggcagctcgcagcctagcacggagcccgcgcctgtgcgggcgcctggagctgcccgctccgccgcagcagccgccgcgcctggccgtacgctgtggccggaccccgcggtcgctcgctcacacacccctcgccgctccgcgcctggctcgcccgcgggggccgagcgcgagcgggcgggcgggggaggtgaggggtgcgggcgggtgtgcatgtgcctggctgggtgcacaccccgcaaggcggcggcgccaggacgcggagcgctccccagagcccggctgcctcgcacagctcccgcggctgcgaccatgttccagcccgcggccaagcgcggctttaccatagagtccttggtggccaaggacggcggcaccggcgggggcactggcggcgggggcgcgggctcccatctcctggcggcggccgcctccgaggaaccgctccggcccacggcgctcaactaccctcaccccagcgcggccgaggcggccttcgtgagtggcttccctgccgcggccgccgcgggcgcgggccgctcgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccagggtgagtgtccacgctgtgcccgccgaggcggccggccggcgcccgtgctgcggcgatgcgggggaggctcgggggcgcgcggggctgtttagaagttactgccgggaaggctgcaggtccgcggaggtagattcccaggcagggaagagctgtgcggcatccacccgcgccttcgccgcgtaggtctccctcccaggaaagcaggtggagacctccaggcttttctagaaaatataccagttcggacgcaagcccaggcgcgtcctcggagcctgtgctggccctcgccacagcctgcccaattctctctcccagctgagccagtctcagaccagagtacaactcctcccgctctccctccgcccggcttaacctcgcaccacgcttctctcgcaagtccaccaccacctccgagacctcagccttcgctggcgcgtccgggcgggggaaagtccattcgcgtgccccagctctgggggaagcaagggcagcagggagggcgaatcggagagttaatgttcagtgtggagggcctggctgtcttgggatgtttctcggcaaccttggcccgacttctccaagtcacacgtgcctctcctacccaaggtggggaaggtttgcagtaagcaaactggcttccgccgttgctcgccgccttcgggagggagcccacccggctgctggaataccgaggacagttttcccgggcagggggcgggggcagagggcttttaaggtcgtagccagtccgaaccccggagtttgcatccagcaatcggcttgctaataaagatcctccactggccctacacacacacacacacacacacacacacacacacacacgtttcaattatttgtctttcccggagaaaagagagttgcatttgttggagttcgttttcttccttgaaatttgttggagtttgtttttttcttttctttttttttaaattttattttaaagagtggccttgatttgtacaggcatcactttagtttccagttttattttgttagtgtagaccagaccacagccttgtgagaagggtctatggctcagagctaggtaacccggcttttagagaaacaaatgaaagggacatggctggagcttcggctccaggagctaatgtgacggtctgtagtctaggtctacagtcaattagatgtttggcacagttgtttagataataaaatgaaaattatctcttgacactttgactttcacagaaaaccgctttcccaggtcccgatttgtcaggcaattttttcagtcccacctggccaatagatgctgacctggcagataccacaaaaccagagaatgtaattactagaataagaattgttgtgggtagccttgcctcctctttgaagatttcaaagacttgcccaaatccaaatccgaaaaaacaaaaatgctacaatgtcatctgccttgggcaagagtttctgccacttaaaaataaatgtttactgataacatgaggatatctttaaaattgagcaatctaccctggtcctccgtgggctcgatccgaagcctgggtctcgaaacctggcgcccaggggccgagttgtagttggggcggtgtgtgagcccgcgggccgccgcggccgaggggctggcgggttggaggcttgtggagggataggggctcggaggagagggcggggtcgttcctaagtcctgtggcctccagccgttcagcttgtccggagtcggcatcctgggccgcaccctcggcttcgaatccagcccctgacgccctccgcaccgcggttcctgcctccgggcgccgagggccgggggcgcctggagagaaatccagctccggctctgagcgtctccagtcaggcgaggcggataaatccttcgcaaaaccctcttggaaattgccgccgcttcctgagccatcagtcccagcgggtacgttatcgagtagcacaaacagttggatttttccctcaagaaccgagtctggacgcggagatggagccaagtgtggctgcattttcggacccggaaatccgttgggcactgaaggacttttcgaaccctgtagcgctgttgcttcgcggtccatcgtcgccgctgcagacggatgcgctccccggcggctctacgccctccagtcccggccaggcctctgggctgggagccgagccgtctcgggccctccggcgccgcgttttctagagaaccgggtctcagcgatgctcatttcagccccgtcttaatgcaacaaacgaaaccccacacgaacgaaaaggaacatgtctgcgctctctgcgcagcgcttgggcggcgcggtcccggcgcgcggggaagcggcgtctccgctaaccgaggcgctggaaggggaaaagcgaatgcggaatcgtccaggactccgaaggtcggggccgctcgcgagcaccgaaggggaggagccgacgaagaccaggagtgggccgcatttcggtactgtttccccgagatcaggaactttccgggtctaggagcaacgcctggagggggctgtagagacccagccccccgggacccgcaactacaatgggccggagcttctaaggtcgcctttgttctggcaggaggacggggaatgaggttatctccgccgcctgtcctgcctctccctctcctagccctagggccctccgcccagccgtccggccctgagcccctggccggcggcggcctctccagcgaagactgcggctcgaagactgcagctcggaccccgggtgcttcggatccctagctcccacctccagctccctcattcctgggaatctcttgtgctagttcccagccattgccttgaaggggccctaaaagagtggctgtagaaaaatcggaggggtagggaagcagggaggagaggggtattcatttccctagctccagggacggctataccagtccctttccactttgctaactgtcctagtccgaaactgacagcccgttctcacagcccagaattactgcgtccaaacaggccgcaccctagacccaagtttgttctgcccttgtggtccaggcaagggaaactgaacccctggtaggggtggttcaggcctccttcccacaggtcggggggcggggcggtacaggtacctgtgcacctaaggcatcacccttgtctttgcagaaacatgtagcaattgatctgtttctcaggatgtttggtgttgtactaaacatcctctttctaacagggaaacgtccttattcttttggaatcaaataacctgtcatcacttagcatcttgactcatcctgcagtctcctgcttctctgtgatagggttagaaggacccctgtatttttgcacatgcatgtgaatataccctttaggacacatgctgtctaccacaactggacatgacaatgacctggggccattttctcagtaaggtagacccaaagcaacctagcatccccctaaaataaccagacttgaggcaaaggggcatgtatgttggtacagaagcttgttgccttcatcctctcatctgggtttataaagacaaacacagagcactccaccacacaggtgactgacatataccacataattacaaaataatcactaagtcagagacactggggcagactgcagacctgcttcctcagccccacactgcccttcacacctctgcctcctattcatacacacttacggggctttccacactgcagcctcacttctgaccaacctgggccagcccagcatctgaggccaaaccctgccaatgctgggatgagctaggctttctctctccctctctggttcatttgtccagaggaaaccactgttgggacttcacccaggttcataacaatgttgttttttgaagcaagttattaacattaacaagaagcatttgctttccacccacctttccctggcctacctcactggccccaccccagagactttaatcttccttattccccacctggagcaggctccatatttttctgccctttactcatctctgccagaccacctcccctgaccatctgtctattccactatcccaagtcaaacttctcttcagtcggacctgagggccctagatctgcgccacttgaataatcaaatggggtgtccctcacccatctccctgtgatgtggtcccaccatttttgtggctgcacagatccaaccagttgaaattgataaggtgactggagattattgactgaccccttccaggcactagccccgcaatcctagcaactctgttccacagaaaactccagcaaaaacttggcttctttaggtaaccaaagcccagagacttggaggaagtaaggtcagggagtttccaccaacagagggacaagaacagttacctggagagttttagctacagcatctcaattatctgcttttgattcacttacatagatgtttccagagatgggagatgttaactgaattatccaggtgattgtcttagagcaaagcaacaggtcaaatcaagtccaaccagtagccatctctgaagaaattaattggatcagtcaatcccaacagctaattctgtcaaaataatccatctagggttccgtgtttttggtgcatcaggaggctgttatgtgcccttacatgagaatccatgggtgattttgtcagggcctgttatgagtctgttagcatgtgcaaccaagccagagattgtgtgagggcctagtggggtgttcattgagacaggcgctgtgggtagaggcttgttttggcattgatagtttctgaccccatctcccctaccccagcttcatccagtccagtgttatcccttcctcctgcatgtgggagctgagtccctatgctggccaacatttgctaagggacagtcacactctaaaaatcctatacagtagataggaaaaaagacagtagggaggctggaacatatatttacacacgcccatgcagaaaccaatatatctatatctatatatattagagagaaagatgacatctagatatttatacacatgtttctttagcaagggactattcagggatgaagcagggatgaagcttttcccaccagacagtacttggagtctccagtgtgtgtgttgggatagggggttgggggcttaccctagaggctgggtctctggaccgccaaggcctgggggagagagaggtggagaaaggggaagaaggagcctgactttccacttccaggtgctgcctggaccactgacctagccactggcctatttataccccctgcaagacagagctagagcgtgctggcaggagtttttaatgagttagtagcctgagcattcagccgcaagactagtgcaagcaggtgtgaagggattgctccttgtgtaccttctagttcttgaatctgtgtttggcaaaggtgtgcctagcaccccgctgctccccttatcacgttcctgacccccagccctgcctctaccctgggtcctcttggagggagatgctttgcgaccagttaactgaaagcaaatcgttggggctggcggccagggcagcgcccctgggaaagggcggagaaagagcgccatggacttttcttccccaccccttggcctcttccgctgccccaggcattgtgaatgtgggtccacgcctcgtccggcctgccccatctcttggcttaacagagggatctggagagctgttattccccgcgttcccccgcggagtggctctcgagtgcggggaggtgttgcggaggggagtggacttagggaaggggcggcaaaagggcaaagggagaaatggcgtgtgtgtgcgtgtcaaggaatggagagggcagggcgcttgggagcagggcgcgaggccaggctctgttgggccccggctcacggcgccccttctctctgtctgtacctgcgtgtgttgccgtcggcggcggggccgcagccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtaatcacccccggtcgcggcctgccctgcgcccggagcccgggtggaggtgagggtgcgcgggtgcaggagaggccctgagcccgccccagcccagccctgctgggttccaaaaggcccccattccccgcggcgctgcggtcaagcccgtctttagagcctcttcctcgagactgcgtgcagcctgctgagcccgcaggacttttgtcaagcgctaaagacctagcaggaggcagagtaaatgcaaactgtatcccgagcccggctcccaaagctcctcacggggggaccaggttccctggaggaagcgggtcgcctcgggagcgggcagcgcaggcagcaccgaggccactggagctggctccagcc

SEQ ID NO: 441 - DNA, 8000 bp, Homo sapiens
  Locus number 53 genomic DNA region, homeobox protein Hox-A6 (Hox-1B)
tcctgccgcggccatgctcatgcttttcagcttattatcttttttccacttcattctccggttttggaaccagattttaatttgtctctcggagaggcaaagagcatgtgctatttcaatcctccttctgcgggtcaggtaacggttgaagtggaactccttctccagctccagggtctggtagcgcgtgtaggccgtccgggcccttttgccttccgggccgcctatgttgtctgcaatagaaaagtcagcggtttagccaccaactcctgtcttccaaagtccgccagggggacaagcttgggtcatgagcagggaacccaggcgaaaagctcaacaagttctgcctaccagcccgcacacccctcccgaatttccttctctcttcctttctagaaagaaaacaatacgatttggaccctgggaacaatctgcccatctgaggctggggccgtgtcccggcggactccggctttccctggcccctctcctgccccctccgccctgccccgggcgccccgatcgggaggcacagccctcccaggctgcccaccgcacagaaacccaggaagcaaggccctttcctgagcgcccaagtggccttcgggtcaccctccctcaaagttccagccccgagagccgcctcccgtttccagcctgcagggttggggagcctgttttctttttcttccctttccttctctctccctcctgcccccaaaattcagaatcctgcaggctctcgcctcgattctttcccccaagccccttttcgggggctgtaattagtaacgctgtttccccagcgtagccctcctcataaattatccgccgtgacaagcccgattcacggctgctacagccatcctctacctctctgcgccttgctcggctggcctgacccgggagcgcgtcccaaggcgtggggttccagaggggttttttgcttcctcccccttccaacgtctaaactgtcccagagaacgcccatttcccccactatttgtgagcgcagggtgctcgcaaagaagaggaggaaggaggaaggcaggggagggagaacggcaaggagagctccgcagggctgggagaaatgagaccaagagagactgggagagggcggcagagaagagaggggggaccgagagccgcgtccccgcggtcgcgtggatttagaaaaaggctggctttaccatgacttatgtgcagcttgcgcatccaggggtagatctggggttgggcgggcggcgccgggctcggctcgctctgcgcactcgcctgctcgctgctggcaggggcgtcctcctcggctccggacgccgtgccaaccccctctctgctgctgatgtgggtgctgccggcgtcggccgaggcgccgctggagttgcttagggagtttttcccgccgtggtggctgtcgctgccgggcgagggggccacggcggagcagggcagcggatcgggctgaggagagtgcgtggacgtggccggctggctgtacctgggctcggcgggcgccgcgctggcgctggcagcgtagctgcgggcgcgctctccggagccaaagtggccggagcccgagcggccgacgctgagatccatgccattgtagccgtagccgtacctgccggagtgcatgctcgccgagtccctgaattgctcgctcacggaactatgatctccataattatgcaactggtagtccgggccatttggatagcgaccgcaaaatgagtttacaaaataagagctcatttgttttttgatatgtgtgcttgatttgtggctcgcggtcgtttgtgcgtctatagcacccttgcacaatttatgatgaattatggaaatgactgggacatgtacttggttccctcctacgtaggcacccaaatatggggtacgacttcgaatcacgtgcttttgttgtccagtcgtaaatcctgcctgatgacctctagaggtaaactcgtgcactaataggggagttgggtggaggcgaggggggtggcgcgcgcgccccgggcgcgtgcccgccgccagttgccgccgttcagccggactcgagcgccacccgctggaggcagggctcatcgcccagcttccgaccgggggctgcaagggccggggtcgaattgaggttacagcccattatggcaaaattattgcatttccctcgcagttccattaggatgtaccaattgttaggccgtcagctgccgatcgcgcgcccggcgaggatgcagaggattggggggaggtggtgacttgcattttatttacaacaactttatttcccccgttttgcagcccctcttatttttgtgtcgaggttggggtcggtactgaccgtcctgccagcagctctgaattttgaaaatacagatatcaccttcggggaagggggaaagccatttagccaattggagaaataaatcctgcccgcagcagcagcagctacaattacggctctgtttttgcgagcgcatgagggacagtgtccctgccgctcttaaatgacaggcgtctattaaagatagcttttgtgtagtgtttctccaaggcgaggtcaaattccatacacttttataaccgtagtcgatttttctttcgtgtgaatatggttttcgtgtcattagtttgcgatttgatttgcttacgtatccagcctggaaaatcttcatcacagggtccggttcctcgagccagccgggccccaagtcggagggttctccttgaacccagcgagtgggcccaggctccctgcagccacagaggctgcctggggtctggggatccgtggggcgggttactggggtcttgcttagacctccaggagtaaaatgagggcgataatggaagcattccttggcagtgcctagtatctctgtagttattttccacggctccgaaagactcaagtaaatcacaaatatagctgagaggcaagtggagtctccccgctggaggcccggcgttgcaggcgcccctggcacgtctggaagccaggactctggcggctcccatggccctgggcccctcgttgggtcctgaacgctgctgtggcggcgacgcgggcgctatcggaggctgggagcgggaatccggagccgggagcctaccccgggctgtaatgttccacccgcgcccaggttaactcgcctcggctgaggctgcttctcttccactgacggttgcacacgcgggaccgagagactgggctctgttggggccccctttgttcctcgagcttccttcctgttctgggaggcggcttgggaggccgcgacaaggccgggctccagctcttagaccccctctttccactggccagagatgatttgatgatgcccttcgggacttactggcgagggacttaggcagagacgcccagacacgaaacggggctcggcccagggctctttcctccccagcagccccgcgtcccgaggtcggggagctcagagacactagcacaggagccccagacgcattcagggcgcaccccagaactccggagccggtttgggcatccttgtggagcgggactgggtgtgtgcagtgcgccccgctccaccgctggtattggctgtgtgtgaggttttgttttgttttgttttgttttgttttgttttgttttgttttgttttgtaagaaataaatgcacagacgcttgcaaagctccgggctcccctgaagctgcggaagcccccagatgggagcaggcggggagaaaagttggggaacaggcgagggcaagggggcaaagccgaaggaggttgcagcgctggcctggtccctgcccaggcatctactcgcccgcctttgcctctgagtcctccccgctgggctgcgtggaattgatgagcttgttttcctttttccacttcatgcggcggttctggaaccagatcttgatctggcgctcggtgaggcagagcgcgttggcgatctcgatgcggcggcgccgtgtcaggtagcggttgaagtggaactccttctccagctccagtgtctggtagcgcgtgtaggtctggcggcctcggcgcccatggctcccatacacagcacctacgagcagaaacggccgggcgccggtaagccagggcctggagggttgacccagtcagcccagtgcctcccacaagaggcacccagactagaaaccaccccgcctccactccagcctctcccactatgtctggggcccaaagcatactgaatgggagattatttcataccaagcgagatgttttccacctataacgacttggggtggacattatcgtttttgaaaaatctgcctcataggaaaaccattacaagcaaaataacagaatgagcattcttaatttgggatgcccaggtcgtgtttttgtggggatgcagggtgtgtgtgtgtgtttgtgtgtgtgtgtgtgtgtgtgtctggggtgggtggtgtggaaccatgtaagtagtgtacacactctgaattcatagtggtctctctgaggatgctactgtgaccagccatgtcggaactcaacacattttttgaagagttaaaaatggtcagccctcttgaatctttacacattctcccaaattatatgacccttctgagaaatgcagaactcccccaaggataaagtggatgttaatggaaaacattataattttaacaatccgcattaggctctgtcctagggaattcctaggagtctttgggattccctgtggagtccttggaaaccagaggctaagagatggagctataggtagtctaggatttctggcaatgtaggattgtgttgggctgtctgatctggtgccaaagttccccaagggtggtggggggtccctccaagacaggtgtatgaagctcaggcatgggctcagaagagggcagaagttggctaagagtgggcagttgagtagaagccgggggagatgagggaggagagagaaaaaaatcctgagtctggggctgtggccctccaaggctttggggagacactggaagaggccaaatggccacctctctgtacgggtttctgaagggcagaaaggagagggggttgggaagcaaagggtatttatcagtgacgcagtgcaaaaggccctctggcttgggaagctgagcagggtactcagggtgcatggacaggctgtccctccccaccagcctctctctctcttcaggctgtccctgtcacaggtctcatatacgtgccagtgcccccatcctcccctaaggtgtcagcttacatggacactggggccttgcccttcctctgccatggcctgatagccccattgggaactgattttttcttctcttttaagaagccaaagaaactttgctggttctttcatcctttctttctctctattcctctttctactctgtttcctccttctttctttcttttcctgcctcctttcccctctccctccactgtcttgggatatgtcttacccgcgcaggagttcatccgctgcatccaagggtaaaccgggctcgtgtacttccggtcggcgccttcgtcatggagtgctttgccctgcccgctgctgctgtcgggtttgtactgctgctcgggagaaaagtgcaggtagtccccggggcccctctgcttgccactgcccgagggcgaggcgccactgaggtccttatcagaatagaaacacgaggccccgtactcgtaggacgcccggttgcaggccaggaccgagttggactgttggtagaaacaaggtgaggtgtacgtcttgtccgggagactcgacgccccgtacgaggccgggaagggcctcagcgcgtcatagccagcctggtagaggggcagctggcccaagaaggagtcctggccgctgggaaggctcccggggaaagtgggattcacaaaataggaactcatttgcgcgcccctctgcaggactgtgatttgttgtgtattagtacatctggctataactattagtagtcatcgaactggtttgtttctggatggccgaacgccaaaagcgacagcagcaaatcgcaccagctgacgcggcggcggccaatgggagcgaacgccggagcccgctccccggggaccgcggcgaccgaggcagcaaagttacaaacagcccccagcccgcccgcccgccgcccgcccggcagattaatgggcgcgcacagctagccggcccggctctcttcccgaacgccagcggcgggcacggccctttcagtggcgagcagatcaggccagagtagggacactaatgcttgggccgcctcaaaggccccgccaggtcccctccttcctcctcccctttttgctttattgaattttgcgggttccccgcccctcctcctccaaacaggaaacctgaaggtcctgctccaggaggggcagtgacaaaggtggctttgctccctgccggcctgcactccaggcacggcccagagttgcccctcccctagcgctcccctattcgtgggtgcgagttcttgagctggagcaagggccatgagaaaccaggccttcactctatgctcttcactcgtgcgccttaggaatcggtgaactccctcattctctccttctccgctagcaccaggggcctgggccttgcagcccagagctgaaggatcacctcgagctgaccaggactcagccaaacgtaggttcttcccacccattccctcctcccacatacacatcctgtttgagtcccaaggggctcaatggcccgcgcctgcctggtgtcaaagcactccttccagctgggcgtccccatcccacctttgaacccagggaattgaaaggccagaaaccactggtttcaacaagaaaggaccgacagagcagtggccgtgagactgggctcctaagacagccgagggacctgctcccctgcctagcgcctggggactcagcatccactgcgagaaccgctcagagctgaggcagataaaaatccagatgtggaatctctctgtccacattccagaggcacagaagacgcagaggccctggccaagctgggcacagagggcagctctgcagggcccaaggccgcgggataattgatgggctcggtttccggggcgcccgacaaccggcactgtcctggggccgccctctttactgcccttcctgggaccgcagggagggctgccgcccctcagtcgctccggaaccgggaatagtctcaccggctccagaaatcctgaattgctttcactgctgtcccaggcctggcggtccccagacaggacattaaaagcctgtcctgagctgctcactcttgcctgagaggtgtgccttcgagatagttgacttttacaacacatggatcaatctcgttttgtaaaatgtgatagcagcccaatggcatttttacaactgtgtttgttgggcttgtaaaaccccttgaattagctttaaaatcctcaattctgtggaggttgaagaaagactatttacgtgatttggatggatttctggagactgtttacaagatctgtaaaaccctggccaatgcaggctcacccggttcaggacttagtggggaggtggcaattggcagtgttccagtaggaatctagtaatgacttagtctcttccttgcttttcaatttttttcctgaactctcctcccacaaagggaaaaaattgggaaaggactggcctaaggtcgacctccgaagagcccaagaggcactcctggaaggcggctgctagcccggcaacgggggctacccctggaagccggatgcctgttccccagtcgatccgtcctggaaagggtttactttgcatataaagcagggcctcgaatgagaggatagaattgggcatttcccacacattacttcagggaaagaattcaataggtgaaaatgaaaactcgagtcaaaaaattaaaagggacttttaaaaatagctgtttgaagaaaaacatgtttgtgttatttttttcttaaacaaaattatcagacaacagtgattttaagcaagttattattt

SEQ ID NO: 442 - DNA, 8000 bp, Homo sapiens
  Locus number 54 genomic DNA region, cyclin-dependent kinase 4 inhibitor A (CDK4I), p16-INK4, p16-INK4a, multiple tumor suppressor 1 (MTS1)
aggaaggatcccagccagttttggtgctggaggcccggccaaaggaagggctgctctcccgtcccgcgggctccgaggtcgccgcacccgggcgcgcctgggcctcgtcacccgcgctcgtgacgcgtgcttacaaaggaaacttttacaggtttcggtgggcagggccttttattgcccttctgctccacagcccccgtgcttaatcggttggttgggaggtttctttcgtccgtggttttggaaagtccccgcctccaaaccgcagtcccgcagtcagttctgcagcctcagggcctcgaacagccatgcttagaatccgtccttctttcctgctccatctacccttcccctctggcttcttttttttcactggagaaagcccacccgagtctctcagcctgcttcggaggttactgcggcctcctccacgggtagttctgggacccgggtctagtccgcggttccggagcaggtccctccctggagtcgtcaggcccagtatgcgtgtgctcagtgtgctcgggaaacacgcgtgggctttaacagcagatctccataaaagggtcccggagatagcctctgcctggcccgaggcccagtgcctcaaagcggacgcctttgcgctcccggaggtgctcacaccacagcggagcctgctggcgagtggagcgtaggactgcgaaccagcaatctcccgagaagcggcgagggggaggggaatgtctgtgaatcggttatccctcccacccccagcagaagtcggggaaatgggggtggaagggggaaaaagggagagaacaggagtggggttgaggaagggtaaggaggaaggtgagcttcctacagctgcgggggaaggtggagaaaattttcagggggacagctgagtggtagagctagcgagcttcagagaaatgttgacagacagatgcccagaaagtgaggatgccgggcatgggcactgcgtaccaggcacaggagatatatggaggcaggaaattggcacatcataagcatttgaccatcctgccctaaaacaaaacaaattgaacaacaacaacaacaaaagataatagcaaaagtggcacagtagtgagctcgcagggcccattcctatatagaaacacagaaaaataagcaaaagctgccagaattgacttcgtgggaactctgggaaacagtaagaaagttttacagcaaccaagtgagtgctgaaccaaggcaaaggtaactgaaacgcaatgatagagaagaggggcagggaagtgttgggtagacaaaggcgggtccctggtaagggccctcccctgggcctgtgcccactggacctaggtgaggacaggcactccttccttcacgcccaaatgttgcatatcccaagaccaccctgtcccgccacgcccccatcctttgcctatgaaaaccctgagaccctagcaggcagacacacaagcggctctatgtccagaggaactcatcggaggaactggacgtggagcggggcaccccagcggaagggagcacgccagtggaagagcacactgacagaccataggagtcagtctgttatattatcatagtataatattataaaattattataatacaataaaaatataaaaatataaataatgtaataaatatggataaaaataataattacatatttatatttatatgagaacactatgaataattttaagccaaaaaacaactcgatgttcatcactggatgagtagacgagcaatttccagtatattcatacaatggaatatgattcagccataaaatgaaatgaggtactgatacatgctgcagcaggaatgaacccccaaaacactacacttggtgaaagaagccagacacggaaggtcacatattgtatgatcccatttataagaaatattcagaataggtaaatccatagagacaaaaggagttttgtagttgccaggagttggaggcaagaagagtttaacaggtatgcttaatggggcctcctatgcagttgacgaaaatgttttgggctagataggagtgatggttgcataacattgtactaaatgccactgaattctactctttaaaatttttagttttatgttatgtggcgtgtaccctaaaaaaaaaaatagaggtgcagtgctccagcacgggatgaggcagcgtggacaggagcatctcccaacctcagtgaagtctgagccgcgtgcctgcaacaatcccactgtggcagagaaccgcagagttccttccggtttggcagcagtcattcgcaacctcacagccctctggaaccccagcctgggggtctcagaacgccgaggcggggactgggagccgagtcggattccgagactatgggccagggttggctggattcagttacctggctgaggcctggtgagcaaaatatcccaaacctcgcgtgatctggaaggggaagccggataaatacggatctccagatgtgccagtctcgagtctatcgatatgaggtccccctagagtttctattcatcattttaaccgcatttcatcgatcttgagacacggcttttgatattttatcacctcaagataaatagtgttagatgtctaatagcagcgtttttctaagagatacatgaaacaacagtgtcagaaacgatgctgtcttccatgcgatgaaattgttgtaataggtgctcaataaatgttgacaataaatgagtgaatgaatgaaaattattttatttttatttgagctttggttctgccatttgctagcagtgtgactcaagagaagccagtaacccccctgagcttccctagttcacaaaatgcttgtcatgaagtcgacagcttccggaggctgcgaggctcgcaagaaatgcccacatgaatgtgcgcttagggcgtgagtgctcactccagaaaactccaacacagtgaaaaggcagaagcggtgtttttcttttttacatttttataagaatatataaaaaatgatataaatggacatttacggtagtgggggaaggcatatatctacgttaaaaggcaggacatttttaaaagctctattttctaaatgaaaactacgaaagcggggtgggttgtggcgggggcagttgtggccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacgcatgcctgcttctacaaacccacaaatggtttccgatcatttctgaaacaaaatggatgctcatttattcatgtgctctggcttctgccttcctctctaatctcgttgcgtatgggctccagctcgccgttcggttctcccgaggcagcatttacacttgagagtctcaagattattttattcctgagggagcatttgcacttgaaagtctctttttacgtttattcctgaggcagcatttgcacttgagtttctttctcccgtagcttgcattagattctccgaccactctttagcttctcctcctattcacacttcatatttacccattgcattggttttataaactcgctctctgaaaatagattgttatcttccttaacgtctgtttcccaggtcgggcaagatagcttgggactgtaatcccagtactttaggaggaggaggggggatgatcgcttgagcccagataacatggtgagaccttcgtctctattaaacaaacaaacaaacccaggcgtcgtggcgtgcacctgtggtcccagctagtcgggaggctcaggtgggagaaccccttgagccagggagtttgaggctgcagtgagctgtgatcgcgccactgcactccaggttgggcaacagatcgactctgtctccaaatgtaaaccccatgagggcaagactcttgtttggtctcattcaccttggcgtgcccaccacctagaacagggctgatcacgcagtagaatctaaccatataattaattgtgcttgaagagggggtgttggggagtaagagaaggaagggaggagggaagaaatgaaagacttgtgtgtttggattaaatatattaggtttggttaagagtcgttcagtttattcatttgcttgtggcccaattcagtagttttactccctctcccacttggctcctcaggctttttgctcagccctggaaccgcgctgtaattggcagctccttctaaatcgggacccggatgctagctgtaactggagccgaagtctccttcttcacctcccgggacctggatgctagctgtaactggagggaattggcgggggggaggggaggaggggccgagtaaagaagaacttcgcgtctttaacttcgaaggtgattttgcgttctgtatttacagcatctccaagcagagggcttagagctaactcttcaccctgtcctccccagctcccctatggcccaaggagcccaatgcccccgttctgggccaaaataagatggatttcataatcttcaaggtcatgttttaccttaaatattcgtgttaattcccgtgtactgtttcatatatctattttgtttcaaaaaaaaatgttcctccccccagaaacaattgagtaatgttggcagtttcagcagacagctgtgggagtagggaactggggccatggaatgggggcggagggaggatgctttgagatcacaaaaaggaaaggcaagggcaaggaggaccataattctaccttcatcgctcagcgatctcttgcacaagtttaagagggaaaggagccaactccggtgcacagactgccagggtcagcgaagtcttggtcctgatgtccccagaaccccctggggcagctctggaaaactctaccgcataaagcggagggtcagattagctgaggagggtcagattagttgagttgtgcagaagagccgagatcgagagatctccagatgatgccacgcacaattgggtttggaaatcctgaggttggtccagccagcttggtatgcaaatgaggaaacagacctggtaagtggatgcaactggccctagtttggaggaagagggggcactagacctctagcctcttgagtcttcattgctccgcagtctaggccttgaactagcagagggtaggtgtttgggtggtggtatgctttgggaagtataatgtacaaaatgggctttcacgtgcgcaagtccatttcgggattatttcccatttgccgccctggcggggcagggcgatagggagactcaggccgtcccaccgattggcgcgtgagctgaggcaagaccggagactggtctcccgggctgaactttctgtgctggaaaatgaatgctctgagctttggaagctctcagggtacaaattctcagatcatcagtcctcacctgagggaccttccgcggcatctatgcgggcatggttactgcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcgtcgtgcacgggtcgggtgagagtggcggggtcggcgcagttgggctccgcgccgtggagcagcagcagctccgccactcgggcgctgcccatcatcatgacctgccagagagaacagaatggtcagagccagggtgggggccggcatgacggaaaggaagcttgtgtagagccccctcaccgccaagcagacccccacacaagccccaggtgtctaattacccctacatttgcttccagtttccaatttccttcttgagttctctatccattcttcagtacacaatgaattccattatatcctccgaacttctgcggagctgtcgtcacaggcagagagcactgtgaggcacgggcaaaatagcaaaggggcagggacagactgacttttactccaggctaacttcctgtatttcccctgagatacaactactgaaatttcttcctgaaattatgttaggcctggagatttttttttttttttttgttcactgctgtatatccaagcgcagaatgtggtaattgttaaaaagagaaaacttgtttgtttgttaaaacaaattctcacaaaacttttaagttacacttagcttctgggaatgttgaacttcaatttctttttcattatattagttttaaaattatatattgggatagtacagttgtatatatttatgtggtacaatatgaagttatgatctttgaacacaatggggaattattaagtcaagctaagtaacctatccatcatctcaaatatttgacatttttgtcaaatgagagcatttgggatttactatttagctatattcatcatgctatgaaacacatctcaaaaaaaacaatcaaacttattcctcccatcttaactgaggctttatatcttgattaccatctccccattcctcccaccccccagctctagtaaccaccattctactctttactgctaagaatgtaattgttttatatttcacagataagtgagaacatgtgatatttgtctttctgtgtttggcttatttcatttagcataatgctctccaattccaaaacttcaatttcttcaagtataaaataagaaggctagtttaattaaccctaaaattccttcctgtggtaggctgaataatgcccccccacccccaatgtctatgtcctaatcctcaaaaacttttaatacattaacttatgtggcaaaagaggctttgcagatgtgatttaattaatggtcttgagggagattatccagaattttcagggtgggcccaacataaccccaagtgtttttattagagggtcacagtcagagagaagatacaagaatggaagcacaggccacagagaaaatacagagaccatgagccaaggaatttgatggtcactagaagctggaaaagacaaggaaacagattgccccttagagtttccaaaaggaatgaaaccttgtggacccatttttgacttctgatctctagaactgtaaaataataattttgtgtttgttttagctaacacatttgtgataatttgtaacagcagcagtaggaaactaaaacacttcccaggtttatgatttgagagttcattaaacaagagatggtcacctctttggttcctaaatcatcttggaaacaaagccatttccagagaggaattttaaaatactgtctgcagtcatagcaaccttaaaatttgagtgctgcatggtggaagtagacaatttattttaggataactgttatttgttatattagtttgaggatggtggtgttaaagaggagttacttatttttaggtacatttcatactaaacacaaattgcataatttgcctaaatcaaggaattatactaaattatattatggttattaaatcctgtcctgagaaagtgaaactgactcagttttcaaagagacaaagagaaagtat

SEQ ID NO: 443 - DNA, 8000 bp, Homo sapiens
  Locus number 55 genomic DNA region, cyclin-dependent kinase 4 inhibitor A (CDK4I), p16-INK4, p16-INK4a, multiple tumor suppressor 1 (MTS1)
ggagcctgctggcgagtggagcgtaggactgcgaaccagcaatctcccgagaagcggcgagggggaggggaatgtctgtgaatcggttatccctcccacccccagcagaagtcggggaaatgggggtggaagggggaaaaagggagagaacaggagtggggttgaggaagggtaaggaggaaggtgagcttcctacagctgcgggggaaggtggagaaaattttcagggggacagctgagtggtagagctagcgagcttcagagaaatgttgacagacagatgcccagaaagtgaggatgccgggcatgggcactgcgtaccaggcacaggagatatatggaggcaggaaattggcacatcataagcatttgaccatcctgccctaaaacaaaacaaattgaacaacaacaacaacaaaagataatagcaaaagtggcacagtagtgagctcgcagggcccattcctatatagaaacacagaaaaataagcaaaagctgccagaattgacttcgtgggaactctgggaaacagtaagaaagttttacagcaaccaagtgagtgctgaaccaaggcaaaggtaactgaaacgcaatgatagagaagaggggcagggaagtgttgggtagacaaaggcgggtccctggtaagggccctcccctgggcctgtgcccactggacctaggtgaggacaggcactccttccttcacgcccaaatgttgcatatcccaagaccaccctgtcccgccacgcccccatcctttgcctatgaaaaccctgagaccctagcaggcagacacacaagcggctctatgtccagaggaactcatcggaggaactggacgtggagcggggcaccccagcggaagggagcacgccagtggaagagcacactgacagaccataggagtcagtctgttatattatcatagtataatattataaaattattataatacaataaaaatataaaaatataaataatgtaataaatatggataaaaataataattacatatttatatttatatgagaacactatgaataattttaagccaaaaaacaactcgatgttcatcactggatgagtagacgagcaatttccagtatattcatacaatggaatatgattcagccataaaatgaaatgaggtactgatacatgctgcagcaggaatgaacccccaaaacactacacttggtgaaagaagccagacacggaaggtcacatattgtatgatcccatttataagaaatattcagaataggtaaatccatagagacaaaaggagttttgtagttgccaggagttggaggcaagaagagtttaacaggtatgcttaatggggcctcctatgcagttgacgaaaatgttttgggctagataggagtgatggttgcataacattgtactaaatgccactgaattctactctttaaaatttttagttttatgttatgtggcgtgtaccctaaaaaaaaaaatagaggtgcagtgctccagcacgggatgaggcagcgtggacaggagcatctcccaacctcagtgaagtctgagccgcgtgcctgcaacaatcccactgtggcagagaaccgcagagttccttccggtttggcagcagtcattcgcaacctcacagccctctggaaccccagcctgggggtctcagaacgccgaggcggggactgggagccgagtcggattccgagactatgggccagggttggctggattcagttacctggctgaggcctggtgagcaaaatatcccaaacctcgcgtgatctggaaggggaagccggataaatacggatctccagatgtgccagtctcgagtctatcgatatgaggtccccctagagtttctattcatcattttaaccgcatttcatcgatcttgagacacggcttttgatattttatcacctcaagataaatagtgttagatgtctaatagcagcgtttttctaagagatacatgaaacaacagtgtcagaaacgatgctgtcttccatgcgatgaaattgttgtaataggtgctcaataaatgttgacaataaatgagtgaatgaatgaaaattattttatttttatttgagctttggttctgccatttgctagcagtgtgactcaagagaagccagtaacccccctgagcttccctagttcacaaaatgcttgtcatgaagtcgacagcttccggaggctgcgaggctcgcaagaaatgcccacatgaatgtgcgcttagggcgtgagtgctcactccagaaaactccaacacagtgaaaaggcagaagcggtgtttttcttttttacatttttataagaatatataaaaaatgatataaatggacatttacggtagtgggggaaggcatatatctacgttaaaaggcaggacatttttaaaagctctattttctaaatgaaaactacgaaagcggggtgggttgtggcgggggcagttgtggccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacgcatgcctgcttctacaaacccacaaatggtttccgatcatttctgaaacaaaatggatgctcatttattcatgtgctctggcttctgccttcctctctaatctcgttgcgtatgggctccagctcgccgttcggttctcccgaggcagcatttacacttgagagtctcaagattattttattcctgagggagcatttgcacttgaaagtctctttttacgtttattcctgaggcagcatttgcacttgagtttctttctcccgtagcttgcattagattctccgaccactctttagcttctcctcctattcacacttcatatttacccattgcattggttttataaactcgctctctgaaaatagattgttatcttccttaacgtctgtttcccaggtcgggcaagatagcttgggactgtaatcccagtactttaggaggaggaggggggatgatcgcttgagcccagataacatggtgagaccttcgtctctattaaacaaacaaacaaacccaggcgtcgtggcgtgcacctgtggtcccagctagtcgggaggctcaggtgggagaaccccttgagccagggagtttgaggctgcagtgagctgtgatcgcgccactgcactccaggttgggcaacagatcgactctgtctccaaatgtaaaccccatgagggcaagactcttgtttggtctcattcaccttggcgtgcccaccacctagaacagggctgatcacgcagtagaatctaaccatataattaattgtgcttgaagagggggtgttggggagtaagagaaggaagggaggagggaagaaatgaaagacttgtgtgtttggattaaatatattaggtttggttaagagtcgttcagtttattcatttgcttgtggcccaattcagtagttttactccctctcccacttggctcctcaggctttttgctcagccctggaaccgcgctgtaattggcagctccttctaaatcgggacccggatgctagctgtaactggagccgaagtctccttcttcacctcccgggacctggatgctagctgtaactggagggaattggcgggggggaggggaggaggggccgagtaaagaagaacttcgcgtctttaacttcgaaggtgattttgcgttctgtatttacagcatctccaagcagagggcttagagctaactcttcaccctgtcctccccagctcccctatggcccaaggagcccaatgcccccgttctgggccaaaataagatggatttcataatcttcaaggtcatgttttaccttaaatattcgtgttaattcccgtgtactgtttcatatatctattttgtttcaaaaaaaaatgttcctccccccagaaacaattgagtaatgttggcagtttcagcagacagctgtgggagtagggaactggggccatggaatgggggcggagggaggatgctttgagatcacaaaaaggaaaggcaagggcaaggaggaccataattctaccttcatcgctcagcgatctcttgcacaagtttaagagggaaaggagccaactccggtgcacagactgccagggtcagcgaagtcttggtcctgatgtccccagaaccccctggggcagctctggaaaactctaccgcataaagcggagggtcagattagctgaggagggtcagattagttgagttgtgcagaagagccgagatcgagagatctccagatgatgccacgcacaattgggtttggaaatcctgaggttggtccagccagcttggtatgcaaatgaggaaacagacctggtaagtggatgcaactggccctagtttggaggaagagggggcactagacctctagcctcttgagtcttcattgctccgcagtctaggccttgaactagcagagggtaggtgtttgggtggtggtatgctttgggaagtataatgtacaaaatgggctttcacgtgcgcaagtccatttcgggattatttcccatttgccgccctggcggggcagggcgatagggagactcaggccgtcccaccgattggcgcgtgagctgaggcaagaccggagactggtctcccgggctgaactttctgtgctggaaaatgaatgctctgagctttggaagctctcagggtacaaattctcagatcatcagtcctcacctgagggaccttccgcggcatctatgcgggcatggttactgcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcgtcgtgcacgggtcgggtgagagtggcggggtcggcgcagttgggctccgcgccgtggagcagcagcagctccgccactcgggcgctgcccatcatcatgacctgccagagagaacagaatggtcagagccagggtgggggccggcatgacggaaaggaagcttgtgtagagccccctcaccgccaagcagacccccacacaagccccaggtgtctaattacccctacatttgcttccagtttccaatttccttcttgagttctctatccattcttcagtacacaatgaattccattatatcctccgaacttctgcggagctgtcgtcacaggcagagagcactgtgaggcacgggcaaaatagcaaaggggcagggacagactgacttttactccaggctaacttcctgtatttcccctgagatacaactactgaaatttcttcctgaaattatgttaggcctggagatttttttttttttttttgttcactgctgtatatccaagcgcagaatgtggtaattgttaaaaagagaaaacttgtttgtttgttaaaacaaattctcacaaaacttttaagttacacttagcttctgggaatgttgaacttcaatttctttttcattatattagttttaaaattatatattgggatagtacagttgtatatatttatgtggtacaatatgaagttatgatctttgaacacaatggggaattattaagtcaagctaagtaacctatccatcatctcaaatatttgacatttttgtcaaatgagagcatttgggatttactatttagctatattcatcatgctatgaaacacatctcaaaaaaaacaatcaaacttattcctcccatcttaactgaggctttatatcttgattaccatctccccattcctcccaccccccagctctagtaaccaccattctactctttactgctaagaatgtaattgttttatatttcacagataagtgagaacatgtgatatttgtctttctgtgtttggcttatttcatttagcataatgctctccaattccaaaacttcaatttcttcaagtataaaataagaaggctagtttaattaaccctaaaattccttcctgtggtaggctgaataatgcccccccacccccaatgtctatgtcctaatcctcaaaaacttttaatacattaacttatgtggcaaaagaggctttgcagatgtgatttaattaatggtcttgagggagattatccagaattttcagggtgggcccaacataaccccaagtgtttttattagagggtcacagtcagagagaagatacaagaatggaagcacaggccacagagaaaatacagagaccatgagccaaggaatttgatggtcactagaagctggaaaagacaaggaaacagattgccccttagagtttccaaaaggaatgaaaccttgtggacccatttttgacttctgatctctagaactgtaaaataataattttgtgtttgttttagctaacacatttgtgataatttgtaacagcagcagtaggaaactaaaacacttcccaggtttatgatttgagagttcattaaacaagagatggtcacctctttggttcctaaatcatcttggaaacaaagccatttccagagaggaattttaaaatactgtctgcagtcatagcaaccttaaaatttgagtgctgcatggtggaagtagacaatttattttaggataactgttatttgttatattagtttgaggatggtggtgttaaagaggagttacttatttttaggtacatttcatactaaacacaaattgcataatttgcctaaatcaaggaattatactaaattatattatggttattaaatcctgtcctgagaaagtgaaactgactcagttttcaaagagacaaagagaaagtataagcaaaccaaattgcagctacaaaaagaaagacaaaatgttgcagtatatttattgttttgtgtattcaatgaagtccttcgtcttggtcataaaactagccttaaaggtttttcttatatttcatagtatgaaaaatctaaaaagtaacccatatgtaaatatttaaatcatgatagaaatccaaagcaaaaagaaaatgaatcaattgaattaaaatgtgtaggatgcttaaacccatttgataatatatccatttgataatatactaatatgaatttagtactttaaaatgttatataaataaatgttcctatattaaacaccaatgtagttaggattctaagccaacatcatttccccttttctacatgttcttctcccgtctccattaaaaattgtcaaaactatccacttttctttttcctttttgtttttaaacaaataaggtctcttctaagatattgtaggactacaaagccaaactcccgggttcaagctgttggcaaaattttagagatgctaagttacccatgtattaattacttttaaatcctcccctaactccctcacaaaacaggagtagggagaggagaaacacctctgttcaaaaatgaggaattgaaaactcttatcacaaataaactatat

SEQ ID NO: 444 - DNA, 8000 bp, Homo sapiens
  Locus number 56 genomic DNA region, cyclin-dependent kinase 4 inhibitor A (CDK4I), p16-INK4, p16-INK4a, multiple tumor suppressor 1 (MTS1)
tctgttatattatcatagtataatattataaaattattataatacaataaaaatataaaaatataaataatgtaataaatatggataaaaataataattacatatttatatttatatgagaacactatgaataattttaagccaaaaaacaactcgatgttcatcactggatgagtagacgagcaatttccagtatattcatacaatggaatatgattcagccataaaatgaaatgaggtactgatacatgctgcagcaggaatgaacccccaaaacactacacttggtgaaagaagccagacacggaaggtcacatattgtatgatcccatttataagaaatattcagaataggtaaatccatagagacaaaaggagttttgtagttgccaggagttggaggcaagaagagtttaacaggtatgcttaatggggcctcctatgcagttgacgaaaatgttttgggctagataggagtgatggttgcataacattgtactaaatgccactgaattctactctttaaaatttttagttttatgttatgtggcgtgtaccctaaaaaaaaaaatagaggtgcagtgctccagcacgggatgaggcagcgtggacaggagcatctcccaacctcagtgaagtctgagccgcgtgcctgcaacaatcccactgtggcagagaaccgcagagttccttccggtttggcagcagtcattcgcaacctcacagccctctggaaccccagcctgggggtctcagaacgccgaggcggggactgggagccgagtcggattccgagactatgggccagggttggctggattcagttacctggctgaggcctggtgagcaaaatatcccaaacctcgcgtgatctggaaggggaagccggataaatacggatctccagatgtgccagtctcgagtctatcgatatgaggtccccctagagtttctattcatcattttaaccgcatttcatcgatcttgagacacggcttttgatattttatcacctcaagataaatagtgttagatgtctaatagcagcgtttttctaagagatacatgaaacaacagtgtcagaaacgatgctgtcttccatgcgatgaaattgttgtaataggtgctcaataaatgttgacaataaatgagtgaatgaatgaaaattattttatttttatttgagctttggttctgccatttgctagcagtgtgactcaagagaagccagtaacccccctgagcttccctagttcacaaaatgcttgtcatgaagtcgacagcttccggaggctgcgaggctcgcaagaaatgcccacatgaatgtgcgcttagggcgtgagtgctcactccagaaaactccaacacagtgaaaaggcagaagcggtgtttttcttttttacatttttataagaatatataaaaaatgatataaatggacatttacggtagtgggggaaggcatatatctacgttaaaaggcaggacatttttaaaagctctattttctaaatgaaaactacgaaagcggggtgggttgtggcgggggcagttgtggccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacgcatgcctgcttctacaaacccacaaatggtttccgatcatttctgaaacaaaatggatgctcatttattcatgtgctctggcttctgccttcctctctaatctcgttgcgtatgggctccagctcgccgttcggttctcccgaggcagcatttacacttgagagtctcaagattattttattcctgagggagcatttgcacttgaaagtctctttttacgtttattcctgaggcagcatttgcacttgagtttctttctcccgtagcttgcattagattctccgaccactctttagcttctcctcctattcacacttcatatttacccattgcattggttttataaactcgctctctgaaaatagattgttatcttccttaacgtctgtttcccaggtcgggcaagatagcttgggactgtaatcccagtactttaggaggaggaggggggatgatcgcttgagcccagataacatggtgagaccttcgtctctattaaacaaacaaacaaacccaggcgtcgtggcgtgcacctgtggtcccagctagtcgggaggctcaggtgggagaaccccttgagccagggagtttgaggctgcagtgagctgtgatcgcgccactgcactccaggttgggcaacagatcgactctgtctccaaatgtaaaccccatgagggcaagactcttgtttggtctcattcaccttggcgtgcccaccacctagaacagggctgatcacgcagtagaatctaaccatataattaattgtgcttgaagagggggtgttggggagtaagagaaggaagggaggagggaagaaatgaaagacttgtgtgtttggattaaatatattaggtttggttaagagtcgttcagtttattcatttgcttgtggcccaattcagtagttttactccctctcccacttggctcctcaggctttttgctcagccctggaaccgcgctgtaattggcagctccttctaaatcgggacccggatgctagctgtaactggagccgaagtctccttcttcacctcccgggacctggatgctagctgtaactggagggaattggcgggggggaggggaggaggggccgagtaaagaagaacttcgcgtctttaacttcgaaggtgattttgcgttctgtatttacagcatctccaagcagagggcttagagctaactcttcaccctgtcctccccagctcccctatggcccaaggagcccaatgcccccgttctgggccaaaataagatggatttcataatcttcaaggtcatgttttaccttaaatattcgtgttaattcccgtgtactgtttcatatatctattttgtttcaaaaaaaaatgttcctccccccagaaacaattgagtaatgttggcagtttcagcagacagctgtgggagtagggaactggggccatggaatgggggcggagggaggatgctttgagatcacaaaaaggaaaggcaagggcaaggaggaccataattctaccttcatcgctcagcgatctcttgcacaagtttaagagggaaaggagccaactccggtgcacagactgccagggtcagcgaagtcttggtcctgatgtccccagaaccccctggggcagctctggaaaactctaccgcataaagcggagggtcagattagctgaggagggtcagattagttgagttgtgcagaagagccgagatcgagagatctccagatgatgccacgcacaattgggtttggaaatcctgaggttggtccagccagcttggtatgcaaatgaggaaacagacctggtaagtggatgcaactggccctagtttggaggaagagggggcactagacctctagcctcttgagtcttcattgctccgcagtctaggccttgaactagcagagggtaggtgtttgggtggtggtatgctttgggaagtataatgtacaaaatgggctttcacgtgcgcaagtccatttcgggattatttcccatttgccgccctggcggggcagggcgatagggagactcaggccgtcccaccgattggcgcgtgagctgaggcaagaccggagactggtctcccgggctgaactttctgtgctggaaaatgaatgctctgagctttggaagctctcagggtacaaattctcagatcatcagtcctcacctgagggaccttccgcggcatctatgcgggcatggttactgcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcgtcgtgcacgggtcgggtgagagtggcggggtcggcgcagttgggctccgcgccgtggagcagcagcagctccgccactcgggcgctgcccatcatcatgacctgccagagagaacagaatggtcagagccagggtgggggccggcatgacggaaaggaagcttgtgtagagccccctcaccgccaagcagacccccacacaagccccaggtgtctaattacccctacatttgcttccagtttccaatttccttcttgagttctctatccattcttcagtacacaatgaattccattatatcctccgaacttctgcggagctgtcgtcacaggcagagagcactgtgaggcacgggcaaaatagcaaaggggcagggacagactgacttttactccaggctaacttcctgtatttcccctgagatacaactactgaaatttcttcctgaaattatgttaggcctggagatttttttttttttttttgttcactgctgtatatccaagcgcagaatgtggtaattgttaaaaagagaaaacttgtttgtttgttaaaacaaattctcacaaaacttttaagttacacttagcttctgggaatgttgaacttcaatttctttttcattatattagttttaaaattatatattgggatagtacagttgtatatatttatgtggtacaatatgaagttatgatctttgaacacaatggggaattattaagtcaagctaagtaacctatccatcatctcaaatatttgacatttttgtcaaatgagagcatttgggatttactatttagctatattcatcatgctatgaaacacatctcaaaaaaaacaatcaaacttattcctcccatcttaactgaggctttatatcttgattaccatctccccattcctcccaccccccagctctagtaaccaccattctactctttactgctaagaatgtaattgttttatatttcacagataagtgagaacatgtgatatttgtctttctgtgtttggcttatttcatttagcataatgctctccaattccaaaacttcaatttcttcaagtataaaataagaaggctagtttaattaaccctaaaattccttcctgtggtaggctgaataatgcccccccacccccaatgtctatgtcctaatcctcaaaaacttttaatacattaacttatgtggcaaaagaggctttgcagatgtgatttaattaatggtcttgagggagattatccagaattttcagggtgggcccaacataaccccaagtgtttttattagagggtcacagtcagagagaagatacaagaatggaagcacaggccacagagaaaatacagagaccatgagccaaggaatttgatggtcactagaagctggaaaagacaaggaaacagattgccccttagagtttccaaaaggaatgaaaccttgtggacccatttttgacttctgatctctagaactgtaaaataataattttgtgtttgttttagctaacacatttgtgataatttgtaacagcagcagtaggaaactaaaacacttcccaggtttatgatttgagagttcattaaacaagagatggtcacctctttggttcctaaatcatcttggaaacaaagccatttccagagaggaattttaaaatactgtctgcagtcatagcaaccttaaaatttgagtgctgcatggtggaagtagacaatttattttaggataactgttatttgttatattagtttgaggatggtggtgttaaagaggagttacttatttttaggtacatttcatactaaacacaaattgcataatttgcctaaatcaaggaattatactaaattatattatggttattaaatcctgtcctgagaaagtgaaactgactcagttttcaaagagacaaagagaaagtataagcaaaccaaattgcagctacaaaaagaaagacaaaatgttgcagtatatttattgttttgtgtattcaatgaagtccttcgtcttggtcataaaactagccttaaaggtttttcttatatttcatagtatgaaaaatctaaaaagtaacccatatgtaaatatttaaatcatgatagaaatccaaagcaaaaagaaaatgaatcaattgaattaaaatgtgtaggatgcttaaacccatttgataatatatccatttgataatatactaatatgaatttagtactttaaaatgttatataaataaatgttcctatattaaacaccaatgtagttaggattctaagccaacatcatttccccttttctacatgttcttctcccgtctccattaaaaattgtcaaaactatccacttttctttttcctttttgtttttaaacaaataaggtctcttctaagatattgtaggactacaaagccaaactcccgggttcaagctgttggcaaaattttagagatgctaagttacccatgtattaattacttttaaatcctcccctaactccctcacaaaacaggagtagggagaggagaaacacctctgttcaaaaatgaggaattgaaaactcttatcacaaataaactatatcaagtaagctaaagatagtaaaagagcaaaaatgttagcagatattcccaaaatggtaactacatattacctctggaatgatcacatgaatgtggctcattatttcctaagttcctacagcaaacatatatttatttgccctactcagttaaaaataaacacaatatgtagttgcttctgaataatttttctctctctctttctctctttctttctttcgacaaagtctcactctgtcacccaggctggagtgaagtggctccatctcgctgttcactacaacctcagcctcccgggttcaagcgattctcctgcctcaacctcccgagtagctgggattacaggcgcctgccaccacccccggctactttttgtatttttagtagaggcgaggtttcacctgttggccaggctggtctcgaactcccgacctcaggtgattccccccgccttgatctcccaaagtgaagggattacaaggcgtgaggcaccgcgcccggccgcttctgaataatttcgatcaaaatttatattcgatatttattccaacatacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttcccaagcccccagggcgtcgccaggaggaggtctgtgattacaaaccccttctgaaaactccccaggaagcctcccctttttccggagaatcgaagcgctacctgat

SEQ ID NO: 445 - DNA, 8000 bp, Homo sapiens
  Locus number 57 genomic DNA region, cyclin-dependent kinase 4 inhibitor A (CDK4I), p16-INK4, p16-INK4a, multiple tumor suppressor 1 (MTS1)
tttttagaaaattgttttggtcaaaactgttgattcagatattcagactgtgacaaccattctgaaggaattaaaaatccagttatcttcagtgattcctttggaaattattattctgggttattagatagatagactaataactttttttccagttttctaaagctaccttgatttcctgtcttagaaaacaggggttcacaaacactgcttaatatctctttaatgattatgaatactagaatagcttagaggtataccctaaaggccaccatatagatcttctgtacagatgtgaatttaaaagtatgcaaatttacactgattttacctaacaccttggaacataccaggagtctgaatacataaatatatttttattatgatatgtatatttttaaagtggagtttagaaatttctagctacactgaaaaattataatgaagtaggtatttactgtaaaaaactaatgtgctttcttaagggcatagtttaattaggcactataataactgacaaacgtacactgtgtaaaagtttacagtgactcttcacacatactattttatctacctcttattacgggactaccatagggtctcaggtttacagatgagaacatgaaagcactgagagtttctcatacttcattctggtaccatgacagctaataagcaaaagaaatagaatctgctcacaggtcatgtgaatgctaaagaaagtaatctttcaactgcacgcttcaagtggttcctgtgctggtgaataggtatcccacttattgcttttaaattaaggtaggaataagtaatttatatgtacagtcatatgagaatttttcactggttttattttggtcaaaaaataaatttttgaaagatgttaacctcctttcaaccaataaatatttactgtgacttatacggctgatgcttgagtatagtagaggcccaaaggggttaagcgactttcaaaataatagttaactaaaagagatggaactgaaaccatatacatatttatagcactccatgggcaaccaagttcaactatatatgaattactagtcaatgacttttggtaggccatgcaacctatctgagcctcagtctccagatctacaaaatgaaaaaatgaaacattgaaaacataaggatattgtgataattaaattagataatggaagttgaagtgtcctattattgttaagctcctcctaattgtttttgaagaaaacaataactttaccatgtgatttaggaagaaagtttcaataagcttttaaaaattaaatgttaaatataatatattcaacttcaactattcagcatgtaaattgcatggagtaaaattcaaagtgtccgatgttggacatttaacaattagatgttcaactgggggagtcattgttctctagacagctgctgtttctttaaattgggtgagagagttatacaattgctgagtcagatgatctggcagcctgaaagagaatgagagcaagaaaatggtggcactcgagaaaagaaagcaaaacaagctttttcctaatacatcagcaaagtcactggtgtaatattagacaaattttagcttaaaagcagaaaaatgatcatttgaaaggcatgatattttagtttttcttataattgttactttttagcttacatttttcatctatatttccccccccatcactgtgcttttacagagacataaagacccatcattttgtccataaatgctttattctgttatggctacattttcctgcaatcttgccctgatcttagataagcataagttaaacctgtgaaacacttgtgctttgatttttcttttttacataattttaggttgtcatgtttattacgagcctggtctggatcataaaatgaaagaaaccccttattacaacacacacacacacacacacacacacacacacacacagagagagagagagagagagagagatccattcatcctgcacgaacagaaagaagtgtatatagtgttttaaaaagacaacgtatcttatatagcttatgtggaaattttctgtctggttctgtaagctttaaaacacaaatatatcttgttatatttttttctctcaaactatgttctgactgtaaaaatgtggtatctacaagacattcttttccaattcatacaaagggtcacataataataaagggtctccttcatttggtgaaataactcctccactgattactcagactctcctccctgggatccagtaaactgactctaaacttaaaatcttacctaaaatcctggacctcaattcaaagataaagaagcagaaataaggtttaaaaagtaaaattggtcatatttgtcaaattgtgtcccaatgggccacttgtattagtatctccttcaagtgtttatttaaaatgcagatttctgggacccacagcaaatctgaatcaaattttctgaacgtgaaccccagaaatatgtatttttaaaggcagcccaggtaataatgctgttgttaacctttgccatacttttaaaatttctagttactcacataattcaattaagaaagcagaggcttttttatttacgttaccttgattgtacgattttattagtttcaatttgcttaagagattacatgtctttgttcatgtaattctgaacctctataaaacttttctctcttaaaaaaatcctactgccttcacaaccatttaaataatttatgatattttattttgaaggtgaaagagaaaactgagaaatagttgaattaaaaaatcctttgtgataacatgtttatattttcatgaacaaagccaataagtcataaaaattaaaaatcaacatactattttttgaaaggacctctgatgctttgggaatttcaatcctgtagttgatggctttcacttttttttcccttttattacttctttttgattgtagagttctgcccaaatgaaaccatcattccagggctcatgaattaaatgaatgcactgagagacactgacaagcactgagaatttcttcaaccaccctttttaaaaaacaaatgctaattggacataaatatgagaacaatagacattggggactactagatggaggagaaagggaatgagcgagggctgaaatactacctactgtgggtactgtgctcactacttgagtgacagattcagtcgtactcgaaacctcagcatggtgcaatatacctttgtaattaacctgcacatgtgccctctcctcctaaataaaagttgaaaaaaaatctacgaggcactatatttttaaaaataccactatgtacaaggcactgtgctatatctggaactacaaatattagttaaatagtccaagattcagtgggttcagagactctaagtatttgccattccctttagatggaaacgttctttggtccaccaagccctatcgttctgctctttggaaattctccctcactttcttcataatgccgtccttgactaactctcctctagcaatactattggttttgtatgtgatttaaaatcattcctgtaatttcttctgtttatatggcttcgtacaagagattcacattcaacaaatagaaaaaaaacgctattgacatttggtagcttcgacaattgtaaacacatgtgggtttgctgaatacacattaaaatagcatgaattaggatatggtaaatctgttgcggtcccaagttggtgggtttttctaggaagagtcagaccctttaaaaggaccttttatcatctaccaaacaaatccttcatttattaattcccaaggttttctccatcggttggcttactgtcatggaaattgatcttgttttaatagctacttacttttttttattctaatcaatgatttcatttgaaaagaaaattttcaaacatggggaaagctgcaatataagaagaaaacaatggagagacatcgtcactggaaaaatactacgggccactctctataccatcctgcacccccagatggagaaactgagggaagtcgtggcctttcaacactcttgggtctccatctggcttggaagggaacgaaatggctgtcaagagtctcagaagcgcactttccccgtggttcctccgggtaaccctgactcacttttcatctacccatcccctccaaaacaaggcctagccagttccaagctggagaggtgacccagagttgccttctgtcatgtcctgcctttcgtctcgagtccactaaccccactcagactctgtctgctcccacccccaccgcggccagtgaaatcccaatcgtcttccacgtggaaccccaggtccgcagttatgataacggatcacatcgctcctgcggaaagtgcgcgcggtggagtgataattggacctagcgtctaaattcttgttggaggacctcgttccagctgccagttaagcctctgggatccgcagcgtctctaggaattgagagagtggggaagttaggatccaggaggaggatggtgggggctgaggagtggaggagcagcgtgcatctcatctcttgtcgccgggcgggcgctctttcgggtccagggcccttgcacccccagcgtggctccggaggcggcgagacctgcctgaaattgattggaggggactagagtgtgcttgtggggtggggtagtgggggcggagagaagagatcccaagaagggcgccaagtgctgtgaccagaggcctaacacgaggcaccttggaaacaggtatagctacggatttatgggttttaaaatggaacgtcttggtgaatggacatagcgtgcatttcacagtctgacgtcacagccctcgcaggttttcccagaccttaaagccacgttctcgtgtatgacacttaaacaactcagtttccttgtctttcctccctccctacccatctaagggtagagaagctcttagttcatccactgtgtaggactgttaccgtgtgtcaaaggctttggaaatgtatattttactgatgatggtcatagcactttggaaaactcaaaagtgaaacgaagaaaataaatatcaccaaactttttcccaacccctctcatcctgcggaaaccattataactaatttggtgagagagagagagagagagagagagagagagagagagagaaactgtttactgtttggaatcttgctttaaaaaaacctgactttataatgcaatcatttaacagtctatgaaatattcttcagatacctgatgatccagaatgtaactgtaccataatttaacactttattgctagaattttatgcagtttttgatttcttgctactacttatccatctgtattaatctttgtcagaacctttctttccttaggatgatgcctgaatataaaatagctgaatgaaagtggatgggttcattttaaaatacaaaattgtttttcttgatggtgaagtgtttaagaggtggattaatctcattgggcaacaaatagagaagatattagtagttaggtatatgagaatcagaattcagataatttgtcttaaaaattcatattcaatgtaaaaattttatatttagaaaatgaaactgtacccattgtttatataacttaaactgccaaaataaagcaccacaaaaactttttatcacgttggtttttgtatcaggctgggctttgcagcagatggaggagctagggcaagcttgtccaacctgtgggcccgagggtcacatgcagcccaggatggttttgaatgctgcccaacacaaattcatacactttcttaaagtatcatgagtttttttttttttttaagctcatcagctattgttagtgttagtgtatttaatgtgtgtcccaagacaattcttcttcttcctatgtggcccagggaaggtaaaagattgaacacccctggcctacagtgttctactatgaagtttcagttttagttcggcctagaatgttttagtacagaaggcaagtgagattttctctgtttctccaaggacttttgaaaaagtgtaaaagcactgggcccactgttgaaccttgctataaaaaagtatttttgataccatttgtatcactttagtaataggagtttttcatatgttgggaaaatggtttagcttaactctatcatggtagttgatagtgatgaactaacgtggaataatagatctgtaaaccatcatagacggtaataggctatgttgttgctaccttaggatcataatggactttctaaaattcaagagtactcaaagaagtaaaatgaatataagtcttgatttctgaaagggctatggttcacttggaacacaatacaaactgtgaatcatgtacacatggggaataatggtttatactaactgcacagtgcttaccttgagaggactctgtgctattaaagaaaaaaataacctgagccttctgaagtagctataaacaaatgaatatttaacttcataataaaaatatgactattttgtaaatgcaccaaggtagaagtaacaaatcaactatggcaatttttcaggtttctgtggttaagaaactggtaacgtggaattttagtatatgtatttccaatcatataaaaataaaaagtcataataaacatatttgcagaaacttaaaaaaagttaaaataacatcttatttgcaatgatattaaataattcatacaagtaatttttagcacttgtgcctctcaaggaattgtatgaatcctaacataattagtatccatatatattcccaaatcaatatagccatgggcataaaatatattaatgtgaaatatataattacatatcattataattaacaccgctagattttatattatgtatatcattttacatatgaaattggaaaattgcatatatttcaagacattctatccaagctgtgttctatcttgagaaacttcctgaagattgcgcttttcacatacgtcctgaaaattgatttatacctaaataacaaaaaatgatctatttcaatgaacctatcatttaaatatttttgcatttcatgcatatacattaacatactataaaatattttctctaacttaaaatcaccacaatgttatgttttataggcctaaactaaaaaatacataattatggcatttatatacattgacatgttctactttgttactacagattttcagaggcaacttaataatttaaacaaaatgattttatatagaataatattaactagagtaataaatatttttatatagacaataatattaagaactatattcatacagttaccggtcacagtggctaaacttttgctgatacggataaaccactgttaaaaaaaacaacaaccagggtcttgtcaatgtttcaaaatgaattaaaatcaaatccagcaacaggccctgaaatcctttataagctcctttgactaaattaaaaaaattaacttgcataatatgaaaagtaaaaaataaaatgtgcatttatcctatagattataaatttttgctaatagaaattgagacactaaattaaacactgatagttttaacaggtttatatttccatgtcaaagagacaattaacattgcagtaaaaaaataattacccctccgctggcctttgctttttgaagctatatattcctggcgaagcataccacaaggacggtcataaaagtgaagcctcattaaattacttttagacttattacacaagttttaattagcattgtacatattttaactgtacatatattctttcagttttcctggttataggaaattacactggctgtgtcaacatttgtcaatgtgaggacaaaactaccttggattctgtttttcaagaagtaggcctcatttttaaactgtgctaactgtcgtctgagatgactaaaatactatcagttgggatttctcaggaacagttctacagttctgtcgtttgctaaacatacgagcattgtcccgagc

SEQ ID NO: 446 - DNA, 8000 bp, Homo sapiens
  Locus number 58 genomic DNA region, Feature name ha1p_02799
cgagtctgtcccttttgttctagtcccttcttttagaggaacatggagcaataacaatgactcttaccgaggccaattctctattaggctccaggcagccaaggtgacaaaggatgtgtatcctcatccttcagaaggtgatagttgagaggagcgtgggagaaaaccataagccccccaaggttagggtcacatctattcatctgtattttggtgactagcagagcacctggcaaaaagtagactcttcagatagttttgagaggcccgggaaacacaagaactacattacccttctctagttactcttctatcctgttgtcaaacttggcctcaccagtgaaaacctgcctcaccttggtggctactccagctaagctcctgcttcctgccctcacagctggcttacagcatcaagccccatgggatgagtgctccatcctgactgccatgtctgcactgtgtctgcacagtgtctgtgaggccccatctgtcatgacccgatgctggccagcctggcctgggcagagctccgaggagcatgtgagtgcttgaacacatgcacaatgcaacccccaccatggagtctatgcttcttggatgctcactccacgaggtgaggggcatgggatagttgtctctgctctgtgtgaactcagtctggcctggtagataacacagacatgcaaggcaactgtggtaagtgacagagaagctgccagttggccctgtagttgagaggaagagtaatgtgcagtgtcagcgtgctgtccaaggagttcttggcatggctggaggcacttcacacctgaagatggctggtcagaccactggaacatccctcgttaggcaccatgtgtcagaagcctcattagtgtatcaaggaatgctcaggcttcctggaggattcatccattcacagttgctaaaaggaagcctaccgtgtgctagatggggctgccccagtgccctgggccaggtccctgctgttcaattgggtgggatgaaatatataaacatgaaataaatgaaaatatagggtgtgcaagacagggctggcagggaagggctcatgtagcagggacatctgagtgagactggccggcggcaaagggatggccacagtcttaggtcaggtgagcaggagtgacaggcggactccatgtgagaagggaaagggcactagaagttggggagcagcagggaccaggccctccacctttgtgaccttgtcctgctgtttaaggagtccagtgcattctgcattggcgattacctagttagggtgaccagagtgagcaaataaaacacaagatgcccagttaaatttgaattttagataaacagtaaatttttcagttgtactacacaaaggaacatattaaaattctttgctgtggaggcaaatataaaactaggtagaataggcaaggtgtggtggctcatgcttgtaatcccaacatttgggaggtcgaggtgggaggatggtttgagtccaggagtttgagagcagccttggcaacatagaccccatatctacaaaaaaaattagctggtgtggtggcatgcccctgtagtcccagctactcaagaggctgagtcaggaggattgtttgagcccaggaggtggaggctgcagtgtgctgtgatcatgccactgcactctagcctatgtggcaaagcaagaccatgtctcaaaaaaaaaaaaaaaaaagaaagaaaaagaataagaaaataggatgtaagaaggaagagagagagaagtcacagttaccattgctagtgggaggtgactaggtagaaaactccaggttggctaacctcccttcagctttgccaagagaccagtctatgccatggccagtgatggacccagcccaaggtgcacacaggtgattgggttggggagagtgtggaagaccaagtctggttttccttcccttcagaacccactacagaaatgaacagtgggggactccagttctcaccctggagccaagatggcaaggtgacagcatgtcataacagctgttcagagctaggactcagggatcaagctgagctgcacaccaactggggtgctgtgggcgagcaatcccttattatatctaaggcagataagagaaggagttaacccctaaggatcttgtaaggattaaattagttaatgtagggaaaggtgttagttaaattcctggtccatagtatctattttattttaattcctaagaaaatatagtatctctgtgtctgcttcatcgaccagactgtattgcagatggtttaagaccaggcagcaaatttgaggtggagtcatggttatcagaatggctgcccagaccacaaagctgatttatctcaatcataacagcagcaaattcctgttattgtagtgaatcacagcatgtaagcgcacagatgcaggcgccggggttcagagggctgggttgtgtggggagggtaacgaaaaacagacacttgcagggccctaacaatgtgtgtagcaactgaacctgcagcctgcttacacaaaacaggccttaatgaaactcagtttcaaaatggaatatttttcctaaatgataaggtattgcatatggttcttttcccattgtgtagtaattccttctaaagcaaacattttaaagattttaactgaggttggaaaactaaaacttgcctcagtataaaaatgtcgaagccatctgctagaaaatcacagctctgcgatataaaacacccagagctgtgttgctcaaactaatttaatcacaaaataccatttccttgatccgaagggaaacatttctacttggccactagagctttctggagaaaggcacttatatttgcagtaaggtatattagtaattttgaatttcaaagagaaaacagagcagggattttggaaaacatatgttgaaagggtaatttcaattctttgcagatgagaaaagtttttgttaaaacaactgacagacactgagaaacatggccatcagtttgaaggaaagtaattgagttgtgcagtttgcattttattttgcacacgtttaacaattaaaagcttttctgtactatgagaacaaaaccccccaaacaccaatgcaatggcagaaagttgggagtcaaatcaggcagcacacacacgaacactgtgttcacatgatgaggaccacatttttgagacattttctgaaaagaacctgtatatgtgtgtgtgtgtatgtatatattcttttttcctgccagaatctcttgttgaatgatcatcaagttagttctggaaaataggttccaatattgctccattcattggcataggttgactttatcttattccaatttaattggcagctgttttcttagatagttttgcataaaatggtgctcagagaacaagtagagttttaaacatgacacagtcgtgtatttgaggatgtttatgttatatatgtgcttgttaatttagtagttatgagtttaataataactttgagctctttagacatggatcctcatatatattaacaaaatcagctgtgtgccttaaccaacagtgagcatattttttaaaatgggcctctgaattgaaaatttaaaaaaacccttcagcatcctattaggattgattaacccacaggagggtaatcctggtaagcaaacgtaaccaagattctccttccccagtgattccaagtgcagcctggctctcctggtcaggtgcttcctttactcaatatttcctgatctgttcctagatcctaataccaccctctgcgtcaacctgtgaatgcatcctcactaccagggctcaggacttggagccgggattttgctgacatggtcttttctctggttgtcaccttccatttcttctttggtttgcctttcattttaatgccagattttctaagtgtaagaaaggagggtggagagtgggcagaagtcattgtttccatcatgaaagtcaacatcagtatttcctgtcctggggacaaaccagtgcctcatgtttctggaaacgctgcagcatttaacttcaattttaatctggataacgccaaagcttttcctcaaattcacccctggagtcagctcatagatgctctgattttgtctaccattgctcctccttaatatctctcgcacaggtgccattgacctttagatgggctgtacggtgtggggttcggtgccatggatctgcttctccagggaccaggatcttgagatcttcaggctgggtttccatggaggcatggagctgcttttcctccttcataactgcactcaaaacagccctgttgctctagaatggagacttgggcaactccttctggcacagatttgttcacctcaggtgaaattcagatagaagcaagctgcaggcagtttcacctctaagtccatgggttctcaactggtaacgtcctcttatggatgttagcccatgaggtcaatcctgtagcaatctaaggcttgagaaaaattaatcttctggaaaattccaagaatacatcttagggaaactggctctacctttatgacttggatcacacaaggatatgcttttcatcttggactagaactgagagccaatggatgtgttatctaaaactatcccagtgtgttcactatacagaggaagattctgagattcaagactcaagactgaagaagatcattatttttattattttagtcttatgcacaaaatgatatctactgaataagcaggtttttaataggtgacttatatatgttagcaaaaataaacactttgtcttttagatctattctagtttttcagtagctgtagacttaagtgctaacttttagcccataggataagaagaaaccaagtcctaaaagtaggccagcaccagggttcaggcctctgacttcaagccaagggctcatcatcttgaattgcgcacgaatttttacacagcgccaaaggaaactgcctgtacttactgttgtaggtaagacaaacctttgcttatttttacttctcatgaataaatagttgcaagaagaactgctgaaacaaagggcattaatgagcttttgctacatataaatagggagtgtgaaccagcagtgtggcggaagaacattttcccctcaactacggcaggactatgcgatgttctccaatgagctcatcttgtcaataatgtgtagaccttcatgtgctttttaattatgtgctgattttattacaagtgaacctgtcctcttgtttgttcccttatacatattcactgtctttatacctttcctttccctccacgaactgtctgctcatatcttttgccctttcagagggaatagtctgttttttcttataggcttataatattttaaatgtaatgataatgttaagatttttttgacatgtactttatactttcccagttcattatgtatatttaaatgtttcactaatattttaaaacatacatcttttcttaaattttccatggttttatctcttagccattatgcttttgctttctgtggtatattcctggggagtgtctcactgagacccttcggtttctctaagttggtaactttatctcccgtgatgagaaagcttttcaaagggagagcgtgaccatttccatatagagtacagtgttgttttggggtttaagattctattcccgggtgtcatcacttctttttaaatttaactttgttatggaaaatcttaagcatatgtagaagtagaacaaatagtctaatgaaacctcacttgttcataacctggcttcaataatgatcagtacttagctattcttacttcatctacccctttactctgtgttttatttttcctggagtattttgaagcaaattctagaaatatatatatatatatatatatatataaataccaatatagtatatatatacacacacaccgtattggtattgatatatatatatatacaccataaaatatggatatattttacaacataaaatatggtgtgtgtgtatattatatatataatgtgtataatacacacacacacacacacaccctggaatactacccagccataaaaaagagtgaaatcatgtcttttgcagtaacatgtatagaactggaggccattatctcaaatgaaacgacccagaaactgaaagtcaaatactgtgtattctcatttataagtgggagctaaataatgtgtaaacatggacatagagtgtggaataacagacgttggagactcagaaaggggggaggttgggagggcaatgcgggatgagaaattacctaacagttacaatgtatactaatcaagtgatgattacaccaaaagcccaggcctcatgactatgaaatctatccaggtaacaaaactgcacttgtacaccctaaatctataaaaataaaaaaaggaaaaagctatagaatggaatagtatactgcagtcataataaatgaatctcagctaaatataaaaatcattgtccttttgcaggtgctttgctggattcaggatgcagacaaggtccacgcattgtggttgggtgaggtgtcttttaggtctcttttaatctgtaatacttctccctctcttttaaaaatgcatttatttgttgaaaaaacttggtcatgggtcatttttctgtacagtggattatgttctggatttagctaaatgccctcttgttgaagatttatcttccatgcttcctgcaggtggttatatccaatgcttgattaaactcacattttttttttttggcaaagccactttatatgaatgctgtgcatttcctgttgtaccttcatcacatcaggaagcaacaatgtctggccttcttgctttcaatgttgttaaaattggtgagttcaggtgtcatggacctaggagtcaccaatcctctacatctttattgacaattttctccagaattcagagtcagtggtgagcataatggttgggagtgatgggttggagtcagacactcttcagtttgagtaatagttctgaaagtcacttgttatgcctgagctaggttgctcaacccctcagacctttcagggctgactcagctttaggagtggatactccattttgtgtgtgggactgttgtttgagtggggtgagttgtgtgagctggactttggcccagtcttggcagagtggtagttgtgatttagtggcattcgtttcaagcagatggaatttgtttagatgaccctaaaggtctttccaaatctgacgtactaggatgaattatcagatggctcctatagttgggttaccacatattaacggtaaatctgggggtaggagagctcaccattcagttgtaatagttcaatagagatgacaattctgccagatttggatcctgtgggcagagctgagaggtctgtaaattcacattcactcttcaaatcctggtttatagcagccagtcaagtgtgtcactaagatgaagataaattataatgactacaatttggtaattcatttactttactgaaatcagtgctcagtcatgttacaggcgcgactccatctggttcccatcaatgacagagggagcatcatgtttggacagaggggctgcatctgtgtctatgcagggaaagctgcatggattatccagcaaatcatggtgtagaccaccagcttggccagtccaggtccaagccagccgggtgactctgtcttgctatttattcacttctgcattcgacaagtactgtggacacctgctgtgtgccaggcactgctcgaggtgctagggggagatcaggaagcaagaaaaagtttccctgccctcctggagttgatgcgtattccaactgagaagtgggggtgtagccaacaaacaatgaacataatccccaaatcatagagcaagacatgggtgatacaaatcatggcaaagaaagcattgtgcagactgaggggtttcttatttcctgagaaggacgtggattgcaatttaaggtggga

SEQ ID NO: 447 - DNA, 8000 bp, Homo sapiens
  Locus number 59 genomic DNA region, growth hormone inducible transmembrane protein, dermal papilla derived protein 2, transmembrane BAX inhibitor motif containing protein 5
atcacctcaaataacaactcactgatagagtcatagagggtaacaccaaaaatttttctgatgagcctgatatcagagtgaatcacagaaatcctgtattctaggccagtgctcctcagcctttttttattattgcttccctaggaattcatttcagatgcttttgcctgattccctcccccatgacatcttaatgtcatagctttactagcacatgtgctgtctgcatatccatgcattatatattaaaagagagattttttttaatccctcaagcaccagcttttgcctccatcgcatgttctagacccagatctaccatttaccttgctatgtttttgatatagtttgtatatttgtccccacccaaatctcatgttgaactataattcccgttattggaggaggggcctggacagaagtgactggatcatgggagtggatttctcttgaatggattagcactatccccttggtgctgtccttgagatagtgagttctcaggagatctggtcatttaaaagtgtttggcccttccccgccaactctctctctcttgctcttccttttgccatgtgatgtacctgcccctctttgccttctgccatgattggaagcttcctgaagcctccccagaatcagatgccactatgcttcctgtatagcctgcagaatcatgggccaattaaacctcttttcttataaaatacccagcctcgggtatttctttatagcagtgcaagaacaacctaatacctttttcttaagaaaagctactacaatttctgagtgttggtttcctcttggaagactgaccagaaagcatgacactagtctcaattttctgccaatatctgtccctccacagatactaccccactaatgaccttgtcctttggcccacttacagcatttagttgcacatatgtgaggggtatatattgtcagttaggtgaatgcaaaattgagctacatttttctttaaactgccatcgatgtcattttcaaggccccagtcagtttagagcagacagcctatttattccattttgcaagctcagaacagtctgacaatttgtctgtcagtttcaggatttattaccatcagtcacattggagttcaaagtcctttctcctctcctgggccacaactggattagaaacatttacattaaacaggaggggaaaaagtgtagcttctctgtccttccactctacctcttagtcattgcattgtcatgcagctgccgttcagcaaaatctaaagggagtagtccccatggcttcattgtctttctgtggctggcaggatataacttttgaagttggcacagtttgatctctcacccaagcagagtcaaatggctctgccttgtcatacactaaatggtctgttggtgcccatctgggcatctcacccacacatacttctagtgtcgcctcactactgagcagcatctcgaagggtgcaaacaagcaggtgcgtgctcacaatcacattcttgtgtttatctagaccttagggattccaagggaaaacaaggccaagatggggaagatcttgtaactttcctacctgctctgttgtctgccacttagcaaccacatgagaagcaggtgccaattggtccctacattcagaaacatctgcaacctttcaggaagaagcaccttccctttgttgggagactccatcagggagggcagaggttaaagccccagcaaactccctttccaactctgtttcattcataccacatcttctgatgggaaagcatagtagggcaaggtgagagcatttattttaactgaaagtaaataaaatattttatcttttgtcctggctctgagttttctccactataatgcagcatatctcacttagccagcaagtggagaataaggaattcatcagcagactgtaataaaaaccgtgacatatatatagtattggaatttacgaatcatgtcttttcctttttatttacttatttattcttttattttttattttttatttttttgaagtggagtctcgctctgttgcccaggctggaatgcagtggcacgatctcggctcactgcaagctccacctcctgggttcatgccattctcctgcctcagcctcccgagcagctgggactacaggtgcccaccgccatgctctgctaattttttttttttttttttttttttttggtatttttagtagagacggggtttcaccatgttagccaggatggtctcaatctcctgaccttgtgatctacccgcctcggcctcccaaagtgctgggattacaggcgtgagccaccacacacagcctacttatttatttttaaagacagcatcaccctatgttgcccaggccggccttaagctcctgggctacctccccagtaactgggactacatgcatgtgccaccattcccggcttgtccttttctctatcctacactctaagaacttagaagcagagaacttaacaattaaacacttcaaactaagttttatgtatctacttcccctcacttgtatctctccctgtatcctattgctaaattaatgataaaattatccacccagttcagaaggattactcagggagccttcctcattcttatcagctatatttgaccgaccattcaatcctgcaaactccacttcagcaatatatctctgtcataaacccctctgtgtctttctactggcttaattccagcctttattgccttttggttgaacaactacaataaattcctaattggtctcctggtccatggaacctctcccttcctacactgccacaagagcatatatttcccaatgatatgaccagattcctcccctgcttcaaaatatttgacccctgtggaaacaacaatacaagccctttacttgagaaaggaaaatatgaaatcagacatttttcttccaatatggagagaataagctttaataggaatcttgaagaaagcttgagtcattgacttcaagatctttattctggtactgtgttgtaaatcctttctctttgctgataacagaagctctagaaaaaaagactatcactgaaggagccaaacagaaaacctatttgctagctaataaaattgggcatagatcaaaataaaaattaaactgatcatgcttgatctgttcagtttcgtgagatttctctagtgttttcctgccattttcagcgtaaagagataagaattgtgttgctgccagactcttttattatccacatagaaggcaagtctttatatttgtcaaggtttacatgattaggaatcataaatcacaattaactactgcttaggagataaaggttcatgaattttgcatgttgttaatcaccttatcaccctttcagggttttaatctgctctttcttcatggtattaagttatcacattatattttttctatgttctgtctctaccagaaagtaaagccacagagcaaggactttattttgttaaaatagtggtagcacacacgggtttaattcatttgctgtttttttgtttttgtttttttggtttcttttttttttgagactgagtctccctctatcgcccaggctggagtgcagttgcgggatctgggctcactggaacctccgcctcctgggttcaagtgattctcctgccttagcttcccaagtagcttagattacaggcaccaatcacgcctggcaaatttttgtatttttagtagagacagggtttccccacgttggccaggctggtctcgaactcctaacctcaagtgatccacccgccgcggcctcccaaagtactgggattacaggcttgagccaccacgcccggctgattcatttgtatatatttctagaacagagcttggtacgaagttgagcattcagtaaatatctgttgaaatagagggagagtgaaaaagaaagtaactctctcgcgtattccacaactagctcttcacctatcaaattacgcgcaatggaaacatcttagtcctcagagcaatcctgggtgcaaggcagaggcggctgttatcaggcctattacacaggtttagggtgaaacttgaaaatgtgggcgggaaagtcacaaagcaatgaaaaaaccatctagaaaaaatcttttctggatgtcaccatctaacatttggcatgagaccccagaaaccggatgactcggctcagaagcagacacatttgaaaagatatttatctcacgataaattaagggacaaaaaggccttcaaaaaggaacggaataaacggaataatttttaactctaacattactttctttcaatttttacataattcttatagctgcggcgagtgaaacgactaaaacaaaagcaaaacagagctccactgcccaaaacaaagatggccgagacgactcccatgcccacacgcaaaatggacgctgactatgacgttccctgcaacaatcctcaactggccccgccccaccaatttggaaccccgcctcctcaacccggaaccccgcctcccccagtgtggccgcttttccgacagaggcctgcccgtgattggctgctcgtactatttacgtcctttcgatgttgcgtcatgcagtgcgccggaggaactgtgctctttgaggccgacgctaggggcccggaagggaaactgcgaggcgaaggtgaccggggaccgaggtactgctccggctggccggcgggcgcccgggatccccggtggtcctgacagccgccctcacgggaccgctgggtgcggggggaagggctggaagcagcggtgctgctggctgcgtcagggccggcctgcgcgttggggtcgcagtcctgtgggtgacctggtggagagggcggcggcacaaggccctggtcaggcgggcaagggctcagtgtagctgtgcttctgtcctcgggcaacaaggtgctgagtcatccttgcggcgaggccgtacagccgctgcgctggtagcggcacctggggcaggggcagaggtgttgtgggttgacagggaagtttgctgccgggttctcatctgaatctagcgggctgggtgaactttctcggggaccaggcacccaaactcatcaatgctcacggaggcataagcccttggattagggtcggtagtattttccccattttatagcaacgacatctgagtcttagagatccacactcctcacaaggtcacttctaacctgtcagaagcgggattcccactctgggctgttacgccacatggaggtcactctgagctggacctcttcggccccaaccagtggactgagtactgaggaagatacaggacagccataggttgagatgatgtaatggcacgaaagttccaaaagcgctgggtgttttcccaaaggccgggtgccgaattttaagacccttaatagttcagttgcagagctcggaggacgctcgggtatcttaaagcaatagttcttagcttttggagtgttcgttaaaacacacgttcttggtcttattcctaggggtagaatcattaggagcaaagaaagacccaggagcctacattttaagatgcatccggggcactttcaagcaggtagtctaagggtcaacgctgtagtctgaacacggaatccttatgttacagatggggaaatgggcccagaagtatatcacttgcctagaattcactacaaatcattggcagagatgggctggtagccccagttggtttacactcgtcatttcattctgacctattgtagtcacctcaccttagcattacagaaacactgtctgctgacttctggttgaccacccatctagtataatgtgccctggagctaagataatccagtttttagcatgcttttcttttgaagacaccatcgagggagtctaatgtaagggaaacctggttggtaactgagtttacttgtttactttgaaagactaaatgtcctttacgcattatagtaggacatatagaataggttaacttagaatatttttatatctcatgttgaaggaaagtaatatttggtatgattagctgaaattcatatagttggcttcttttaataccttttagctttgtaatgcagtataaccttgaagagctattcatgtcttctttggatgacactattcctttgcccaaaagttatgtagattcttttaaattttcccactggatgctggtataaatcttaagccaaaactacatttgtaaaaaccatcacagactctgtaatcacgtccagttattaacagccgttctgtgttacacataatttttgcagtcatctattttgattggtcaaactgggacttaaacctagtttgttcctccatcttcagctgtgttctctgggatgggtttcttgcattacagtggatggttgggcaaagaattcatcgctgaaaattaaaaaggtcgctttatttcctgttctactaaaaaatagtttgttccttgactctgactctcatatgtccttctcttaattggttagtaggttgttttacttatgtttttttggttggttttgccttttttttaaactagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggtaaagataatctgaatgtttttatattgcttctttttccatttgtgccctttctttttggcagagtatggctgctctgcctttagtgtgttatacgtcagttagccctgataatatccccaatcagctctttctccccattagtttgtatcattctggtccctccttatcccatatgaaatagaaaatgagtttctgtaactctgtcttcgcttacagcttctggagtttctcatttagaaaatttagagtacattgtgagggattgagagttacatagtgtaacggagatcctggagcacatagtcagaagtttaagaacccagggatattaccagttggccaatagcttattaataaattactaaatatattatctcttatttagaggttgataatatctgtcaggttagaaagaaacccatttttataatagatttatcttctggcattcagattataaggtttgaagtgtgaggtaatgaggacaatataaagaagctaggagacattttctcttttaaattaactgttccactgttgaaaaagagccacaatggaagtagtagtcttccctcttcttggcttcatgttaaggaaagatgctgttcttgagtccatatcccagatgacaaaatatagctaataatgcttgtagaatgcatatcttaaaaatgctaacagattctcaccctggtatttggttaggatttaaaatataacaattctaggtatgtaaatctatagtttgtgaaagaaacaatttttctgaaattgaaactaagaataatataatgaattactaacttccaaaggtggagcacagggaaggtctacatttatttatttatttttacatttagttttttaagttggctaataaatttccatagtgaagttaggtatatagaaagtaccaagtttctttaactagagttttctagtgtaaagggatcttgcattttattttattaacgttctgttttcatgtgggtggtacgtgtctttgtttgcatgtgtgtcaggaatatgccaccaaaacaagaattgggatccggcgtgggagaactggccaagaactcaaagaggcagcattggaaccatcgatggaaaaaatatttaaaagtaggtggctatctttagtttttaacctagaatctatggatatgttttaagaggtccatgaacaacttcctaaaaatatatgtgtatttgtgcattttctgggaagaccacattattattctgagatctgacgacccagaaaagattggtactt

SEQ ID NO: 448 - DNA, 8000 bp, Homo sapiens
  Locus number 60 genomic DNA region, Wiskott-Aldrich syndrome protein family member 2 (WASP-family protein member 2), WAVE-2 protein, verprolin homology domain-containing protein 2
gtacagcaccacacctggataattttttaatttttgtagcgacagggtctcagtatattgccaggactggtctcgaactcctgagcataagcaatacttgtgtctcagcctcctagagtactgggattacaggtgtgagccactatgccaagccccctttttccattttaaaagactgtaaaatgaaggctgggcgtggtggatcacgcctgtaatcccaacactttgggaggctgaggcggttggatcacctgaggtcaggagtttgagaccagcctggccaacaagatgaaaccccgtctctactaaaaatacaaaaaattggccaggcgcagtggctcacgcttgtaatcccggcactctgggaggcccaggtgggcggatcacgaggtcaggagattaagaccatcctggctaacacggtgaaatcctgtctcttctaaaaatacaaaaaaattagccaggcatggtggcgggcgcctgtagtcccagctacctgggaggctgaggcaggagaatggcgtgaacctgtgaggcagagcttgcagtgagccgaggtggcgccactgcactccagcctgggcaacagagtgagactccgtctcaaaaaaaaaaaaaaaaaaaaaaaaaaaattagctgggtgtggtggcacatgcctgtagtcccagctactcgggaggctcaggcaggagaatcacttgaacgcagaggcgaaggctgcagggagggacccgagatctcgccattgcactccagcctaggcaacaagagcaaaactctgtctcaaaaacacaaaaattaaaaaaaaaaattgtaaaatggaagacagactgtagaaaatgaggctagaaaggaaggcaggtcttgcagggtcctgaatgctaggccaaggaacttaaataattccacagtgaggaagaggggagagaaatagttgcgatgtgtactctgactataaaaacacttgttacattacaaaagttaacacagaactttcaaagcttcagaaattcagaatcataaaaagtaaaaagtgagatttgatttttaggcagatcactctggcagggatataggaacagatttaagggggttggatcagagaaagaaggtagagggaggcttgggtaatagtttaggtgaaagtcaatgaagtctaaaccagggcaatattggcagagacagcgagtaagggacagagctgagaaatctgtaggaagtctgagtttaaacagtgactttgcctcttactggctgtatctctttaggcaagttaacttaattttttttttttttttgagatgaagtctcgctctgtcgcccatgctggagtgcagtggcacaatctcagcttactacaacctccgcctcccggattcaagcgattctcgtgccttagcctcccgagtagctgggattacaggtgtgtgacaacatacctggctaatttttgtattttttgtagagacgggtttcaccatgttggccaggctggtctagaactcctgacctcaagtgatccacacccttcagcctcccaaagtgctgggattacaggcatgagccactgtgcctggccaagttaccttatttttctgagccttattttctttatctgaaaaatgggaataccaccacctaatctcataggattactgagaagattaaatgagataatctatgtcaagatcttatccaaacctggcataaagtaggcaatcaacaaatgtgggttcccttctcactctcttcccattctctcctcttaggaattatttatttctgcctccccttgtagattatgagtcctggagggcagagacaatttcttattattgcctcttattcttattcttgttgagtatcccctcagcagctggtacataaaatatgttcaacacaagtttattggatgaataaaggatcagttagcccccacaatgtaagaaaatcttgtttccttgggcataaggtgactttggccctcagatcagcttccccaagataggagtggtctgatcacaagtgggagtgtgagcaatggcatccatcaacaccaccctggaaaaatagctgagagagagcgtaacttcagtaagtggaaataagaagcatcattagctagatgttctttgtcctatgaagaaggaaccagtgtgtgattgattgacttccacccatttggccttctcagagagagacagagagaggcagaaattatgcctttaaaaagcagtgaggtctctgcagccttgatgtgcttcctcgtcagctgcactgctgttgtgctactgtcagtgttcctttgtgtaagacaggcactggcagggtttcacttcttcatgatgccccatctaggtttctctaagccctggatcaactgagatgatccctgaggtaggtgaaggcttaggaatctcagactccatacatcatctggtcatagagttctgtctcctcagcctcctattttaaaggctgggcctattgctatacgggagaatgcaggctttcttgatattccactgccttcactaagggcagtgatgcgataggaggggtgactatctgaaataattcacaccaagatgcctttgctaaggaagatcactaaaatggcattttgacggaggttcttatgggagctggagtggcactagataaatgcagagccaatccaagcatctgcccttcccatatctcagcttcaagcaaacaaagtcaacttgattcagaatgaaatccaaaccacatgcatgtaccccacccaaggcagtctcattcattcttgccaattaaaaaaatatatatagttgagctggctttccttcagctccaaaacagtctgggctaacccccatcttcctcctaaggaagaatggctccagctactatttgtgtcactgtatgttcacacagcttgcaaaactcccaataccccagagactgcagaagtaatctgtaccctgaacttggacctgggggcttgcagcacaattaaatgtgtaccagggtggacaagtcagtcagaatctctccgaaggcatgtttgctttactcctctttgggaagaaaaggggtgggggtgttgggtagataaaaactattggcacatttgaggcttcaacaaagtcaggctacatcgaacagctcgtgtaattacaggcacattccccgacccaagatactgctctgtgaacctcccactttacacacacagaattctgctctgtcattccgtctgcagtttttgctgcagcccttcctgccacccttcccacagatttctgttgaagcaggtggagggggagggaggagggaacctagagggtggtggtagataaagaaggttgaagagaagaagctacaccaaaagggagcctctctttggggaggagagggaggatacattttcgcattacctagggaaggcagatgggggagaaataggaacgcgggaggagaaggaaactaaataaagagcaccaacgacccctgagggcaaagcacaggctctctgaggcactcactcaggctgcccagctgtcggatgacatttgccagggtgatgttggtcacgcattccagctcgcttctaacgctaggcaacgtctgacggcacaggtgccttggctcgatgttcctcgttactaacggcatggtggacctgcttcaggcaatgttctgaatggtgaaaaacaacctaaaaaagaaataacaggaaagtattactcaaccacaaattccaggcacactagggctgtgtgaatcttttttttttttttttttggtcttaccctgatctaaaacagctttaaaaaaaatcttcattctccctatctttttttttctttcatttttaagtcctctctcccttgccctttttaaggtttgctattagaagatctgctatgtaagtttagaaattatggactggtgactgctgcctgaggtacataggcagcatagaaacattaaagtgccaactactgctccaaccaacaagagtctccagaggcaaggaggcatggttagaaaacagcccattcagcagacactggacggtacagatcctatccctggggtgttcataaccaggacagatcagattctaggccaccaattataaagatcaaaaaagaacactgtcacctgataatctccacaatgaaatcaagctgccaatagtgattgatatacatcaggattaacttttccagtccttccttggtaaatggctgttaatgtatagctaaccactaggccgggcatggtggctcacgcctgtaatcccagcactttgggaggctgaggcaggtggatcacctaaggccaggagttcgagagcagcctggccaagatggtgaaaccctgtctttagtaaaaatacaaaaaattggccaggcgtgtcgcgggtgcctgtaatcccagttactgaggaggctgaggcaggaaaattgcttgaacccggaaagcagaggttgcagtgagctgagattgcgccattgcactccagcctgggtgacaagagcaagactccgtctcaaaaaaaaaaaaaaaagtatagctaactactaatgccagtatctcttaagtttagtttgtaaattgactgaacgagagaatataaagtaaaaattttacacattcaatatgtcaaacatgatgctgagtaaactgtgctgtaagattccctggtgctttctcttctacccaacagctccctttcttgctcccatccggttcaacacacctgggccaaaaggctctagagacagcaggaaatgtctggagcagatccggaaaccttccagttactgtttcttatccggtgggctgagcccctttccctaggaaatcccccagcacttcaggttcatgctgagctattgttttagatttagattaccgaattcctagttttacaaggataggagagggttttaatttccacaaaatggatatgactacagtcaaggcacaatgaactgatcctctttccacatcttataaaactaaagaaatctaaaacagcctaatggttttcatgctagggaaaatgacaaattcacttcacatgaaaaggtaaagcataaagttaacatacctaagtcctcaattttttttcttattttttattcttttttgagacagggtctcgctctgtcacccaggctagagtgcagtggcacgatctcagctcactgcaacctccacctactgggctcaagcgatcctcctgcctcagcctcccaagtagttaggattacaggcatgcaccaccacgcccagctaatttttgtatttttttgtagagatgaggttttgccatgtagcccagacttgtctcgaactcctgagctcagcctcccaaagtgctgggactataagcatgagccaccacgcccagcctttttgtttttttgagacggggtctcactctgtcatccagtatggagtgcaatggtgcgatcacagctcactacattcttgaccgccttgctcaaatgatcctcctaccttagctttccgaatagctgggccaagtccccaatattataaactcctctttatatatttaaaaaaaaaaaaaagcaaaacaagggtttatttacatcaaatcttaaaataccagctcatcaccaaaacgttgactgtgaatacaaaatgcttaaaccaaactaaatattacagacatattgtctgaccaaaagagaaaaaaaaatctttcaggctcaaagggggagtagaacccttcggaacagactgctccttgttatggacattctgatctgctacaagtaaaaataaaacaggaagccagcagcttggggaacaagatttcctgtcaccaacagcaacagcccaagaaccaagagaatcagctgtttgcttataactttgaacctccctttaatagtcactgtgtggcagctgtgcctatctttggggtgcagaggtgtttcctgaatacttgtctactgtctaaggaaatgatttccattccacttctctgctgaattccccctttgaccccatgggttttctagtccaaaccctggactttccaatttaactctttccctcttttatttaatgtaaagggtatcaggtactaagatgcaatcttcagtaacacatggtaaagagagtttagaacaggaaaggtgggaggaggttacatatgaaagaaccttgcagggctctgaacaccatcctctaggtgtccttagattcccaaatttcaaactttcaagatcaaccagaaatttggtgtacagccaggaatgactggaaacagccactgtggctcttccactggtaatcatttgagtactcattccagcttctcagaggagctaaaagaaccagaccaccttgaaatgctgtgctgaatgtgaccaatgacagggcattctggactttccctctggatacctaatggaaactagattccagatggctacataaatttcagattgagggtggggggcaaattctaacaccttggtactttagcacttatggttttctaagtgccttggataagcagaacaaacaactaactgtatgtcatctgtttggggtttacctggaaccaagttttctaaagcaaatggcttattgtcaaaaaggccacttaccacaaccagcgggagggtactcgagaaataacaatatgtcaatatctattaggacaaaacaattagaaaagtttatctgctatcgtttaaagtgatttgtttcaaagccaccaaagagagacaaaattccttgtatgtgaaatgacatgcaccattgctcatttttcttttggataatcaaggattggtttgtacaagaagcatggagttatgcatgatctgaaccacaacagtaacttgaccaagaagaaaaaaatcttacattcaggtgaaaataaacttagaattgggcaaaaagatttccaggctctctctctcacacttcaagttatagaaaatgtatcggctttatggagtcgacacattcttaggttagcaccctgactagtacaccttactgtgtgatcttgggggcaattttcctagagacattaaataatatatataaaataaaaaacccactacagggcttttaaaaaaaggcagttataggccgggcgcggtggctcacgcctgtaattccagcactttgggaggccgaggcgggcggatcacgaggtcaggagatcgagaccatcctggctaacatggtgaaacgccgtctctactaaaaatacaaaaaattagctgggcgcggtggcaggcgcctgtagtcccagctactcaggaggctgaggcaggagaatggtgtgaacctgggaggcggagcttgcagtgagccaagatcgcgccactgcactccagcctgggcgacagagcgaaactctgtctcaaaaaaaaaaaaaaaaaaaaaaaaaaagaggcagttatttgtggttccacagaccctaggcaaatcctcctgtagaataaatcctattcactgataaatattttatcttattatttaagagacaaggtctcactctgtcacccaggcctcactctgttgcccaggttggagtgcagtggcatgatcatagctcactgcaacctcaaacacctgagctcaagtgatgctcccacctcagcctcacaagtagccaggactacaggcacatgccaccatgcctggctaatttattatcttttatagagatggggccttgctatgctgtccaggctggtctctaacttttagcctcaagcaatcttcccaccttggcctcccaaagtgctgggattacaggtgtaagccaccatacccgggcccctcattgataaatatttaaaaatacttttaaccatagacatattatatggtggaatgcaatatttacactaaaaatttaaagacaaaactctagccttcaaaggaatttggcaggtttttcctggaggctgcttccagctgtgatcctggacctcctgaagaa

SEQ ID NO: 449 - DNA, 8000 bp, Homo sapiens
  Locus number 61 genomic DNA region, Feature name ha1p_05803
tctctttcattgcaagagacagaaaacaaactaaacttagagtaagcaagaaagagaatgcattgactcacttgttgggaaggccaagcatggagtgggcttcaggcttgactaactctatggactggaaaaaggcatgggatttgtcgtcatttgctcctgcgatacattggcttcttccagatagaagctgccatgctgctagaagctctggggtcctagccttactatactcaattcaaaaggattgaagagcatatctcttttggaatcaatatacaaaaatcccagagaaggaccctgattggtccgacatggttcacatgcctattcccgggccaatcattactagcaggaagatgggatagaatgattggccaggcctgggtcatatgtttttcccagtggccagtgattccacaggcacctaagggcaagaaacaggatacctagacctcagggaacaggcaagtccagcagtttaggaggagaaacagaagctaagctgtcttcttgtggtctccctgggatctcgtgtctgcttctttttgcctacctcctcgttcttctgtttccttgtgaacattggctttggtatttttttcttcctcagcatgtatgtacatggctcaaaatggctgccccagccccgagccctatgtgactttcgagagctccacaccacctgtggctgagttcagatgttcaaggaagagagaatccgatgggttgcagggataggtgttaaatactggacccatcagttgtggcaagggttagggatttgtagtataaacacggcttccgaggtcttcttcccctttagctggcctgtaggggcagttcgttggagaagggggctgtgtgtggggcaggcatttcagaacaagatatcttgctcgtcccaggtgacccagagaacagcaaagcatggcaccatcctgccctcaagtagcttcaagtctagctgagcaggtgagaggctcatctgggccaggggtcataggacatcagaggagggcaaggtcattgtgggccaggacaggtggaacaagttgcctggagccagtgggagtgcagctggcctttccaggtaggcaggaaggaagggacatgaccctgtgccatgaggaggagacgttgcctcagcagatgctcttttcttcacacctgagctggccctgctgaacaaatatgcaaatggatttgaagagtcctgtccattagggagcttttcctcagagcataagcactggtcttcctgaggcttctgtttgacttctcataacaccctctgtcctgggattaccagagtgccccccccgtccactcaccatctgtgtgtgtgcgtgtgtgtatgtgtgtgtgcgcatgtgtgtgtgtgtaggttatggggagtttttcatgatgttttggaaagtcaaggagtttcttctctcctcaaaagccaagaatggaaaaaaaaaatctccaagaataaaaggagggaaaaataaccctttgcatttggagaatgtaaagagatctgtaagcatcctaaggtggagacttctgttgtcatgctgtggtccaggaaagtcctggacttgcccaaattctcatggctgcgactagaaccctggcttttactgccagcccagggctcttctctgagccctcagggacagtggggagtgggcctggcaggggtggtctgtatgtgacaggagtgggggaatgccccaccttcacaaggacgcagtagaggctcaatcctaaaaaacacagcccaaaccaagtccagagaggatttggaggctccggggaggagctaagaggttaccagcgtctcctttgggaagtgggtgagagtccatcccacatgccttatctgggcagatctcatttcctggtggaggaaaaggaggagatctttgtgtttctcctctgttttttccctttcagacagaccagacatcagatctcagtcagataaatccagctgaaagaaaggggctgaggccagggctggcacaaagaaaaggatcccttgccaaagtcacacaggaagatactccaaaagaccctcgcccaaagaagagggcggacggggttcccctggagctccctttccctaagggcctggcgttgggctttcgatcctagttccacatgaggtttcatgtaaatgattgtattattattatttttttgcatgggtgaaaagtcacaaattattaacgctgaatttcaaagactgcagtcttctcactctggggtggcatctcttcactgttcaggcacgggcagcctcacagaacggacgtggcccagacctcacttgacctctgagaggccctgaaggcagtcgcccaagggcaggggcaggggacagggcggagggggaggacactgagcggagcggggaaggaagagagaggaggggtggggaaggagaggaggggcggcggggagcccggagagaaagaagggagaccccggagaggaagagggggaggcccgggagggcgcgcggagggggtgtcagcgaggggccgcctgtcagggttctatctgcgcgatgattgatgcgggcccgggtttttctgtcagcctgtcacggcgcaggaatgtttaatgttctcattattggttacgctgttgtgtatatttctctgtcagcaccgcggacccagctgaactggcagagcacttcaaaggcctacgggtcattcatcatccccatgacgctccggcaaatgctcagcttcagccccgcgccagggatttgttatgacttgcgagccgcctgacagacagggctgcggcggccgggaggggacgcgcgggaggcgggctccgggcccttcctgtcacgccgggcccgcgactccgactcggggggcaggcggcacggcgcggggcgggcccgcctgggcgacccccgggaggggtggcaggaggaggcaggggcgcgccccctcatgggccccggggcgccctcacacctctccctgcagtcccgccctcctcctcctggcgggcggcggcctctcccaaagttgtgccgcagacccagaggttgagggggggaaaagcgaaacttgcaaccgtccagggccagggaggggcgggagctgggagcgagagcaggagagtatcggagctttgtttcctttcccaggccgtgacatgattaatcgttttcttctgatctaattttggaacatgaaaaacagcacatttgtcttgaagaaaaatgatgtgccgaactgcgcagatggaaatttcgagcaatgagaaagattaaagtgaaaccccactccttagacctaatcatgagttgtagattattctgtcggcccagccagatggtagctctgattccacagccccttcttatattaatgaatactcgactgttatatttgacttaggtaagtgaaatgtctatcagagctaatggactgccagccagcataacacatgttgtaccgctaagggtccttctgcatttttcatgttttatactaatgtagaacattttgtttcctactgtttttcatcattgtcactgtttgctaaatattttcacatggaaggggggagagagagagacaaagtcaggaggaaaaagaacccccctccaaacttgtgtccaaagctaatttcctcccgttgggcttggctataactctacaagtaaaacagtcaccccgagcaatacgtacaggaactcaatagtaacgtgattaagttcctagtcaacaagactacactcgactgtatgttaacaaacctaattatagccccgtggtaataaattgggccagggccctggctgcacatctctgaggtcatgtctaggagagctgtttgaccctcttgtctcagggaagagaattgtcctggagaggggtccctgtctcagcatggtagaggggctgttttctccctgacctagttgtccagcccctgggaggatgggtggatgccaggaagcatttcagagcggaaggtcatcggcatgagaactgggtattaggatttgctggaggagaccggaagggcagtggcttctgagccattggcccctttcacgttgtgagtggcatcaggatgtctgagaggagagcatggtgtttttgcttcattggatccatgcaggtcttggagggtggtggcccactctttctgggccaagtagagggtggctcagacacccccccttcctccaggcttctcatctgtaactggtgaagcccggaagagcttgttgttcaagaggaaatcttgtgttacttctttatgaaggactccagcctggtggagatgaatgagtcctgaagatggaatcgaagctgtttgggcacaagtaagctggaaggggttgagggacattttcaaggagtgatgtcttgagagaaaaatggaaagaaatccacaggcagaaaagagatatctagatatgaaaacatggggcagggggagggagagagagagaagagaatgcagagaaagagagagacatacaggagaggacgtgtaggtaccaacagaggagatggcccatgaactcagaggagaaactcttcttgcctcagccaaagtgagcttcctaaaaagccattttgacccctgctaaaaattctctcctggctgtgattcctacgggagtcagttgcagtgtcttggctgggaataggtgagcctctccatctacccccagtttctctctccagccttatctctcacttgtcctcaactgtgaccttgcccttctgccacatgagccttcttaggatccccaagagtgccagcctctttcagaacagtgtgattttatctgtgtttatttctgtctatcctactctcctgtattctttccctggcaaactcctactcatccttcaagactcagctctcagatctcctcctctgtgacattttcctgacattcccaggaggcattattcatcctctgacccccacccccgactctagctaggctgcattgaaaaatgtctgtgtttacaagtctcttgctctacaccttccttcctctacagctattcctctgctcattcgtttactcattcaagaaatgtacattaagaccttactgtgtgacagatattgttctagacactggggatttagcaatatacaaaatcccctgcccttctggaggtgtatttgtggatttcattcatttcagtagctgtatttgtggatgtattaatgaggctcttttatagtaagaaacagaaacttgctcaggctagctctagaaatgggtattactgtaaaatggtggcaataaggaaggcagaaaatctcacagagacccaagagcagctgcacagctgagcttcacagcttctgtaactcgttaattggctcattcatggcccttcctaggcccatgtcatttaagaaactttttattgtgatatgaaatacatacataaaagtgcatatatcacaaaagtacagctcaatgaattttcacaaactacaacccataaagaggtgaagaaacataacattcattaccccagtacctcctatcctcctttatttcatttttaagatacattctcatcccagcttctccccaactgtttaccatgtgatgttttgatttctgttttcactggattcattttataaacagctttatttaggtgaaacctacataccgtaaaatcatccattataaatgaacaatccaatgattttttagtaagtttataaagagcaaccatgatcacaatccagttttagaacatttccatcatcccaaagaatcctcctgagtcaattttcagtcagtactcagttccagccccaaccccagccccagactaccaggttttacgtttaggtctgggatccattttttaaaaataattttactaagatataattcacatactgtaaagcctacactttagaaggtaaaattatgtgtttctaatatatttacaaagctgtacaaatatcacccctatttaattcgagaacattttaatcaccaaaaagaaaccccatatctattcatagtcactccccacttttccctccctttagtcctggaaatcactactctcctttctgtctctatggatttgcctattctagacattccacatgaatagagtcatataatatgtggcctttaacgcctggcttctttcactcagtataatgttttcaagattcatccatgttgtagtatgtatgagaacttcattcctttttatggccaaataatattccattgtatagattcacaatattttgttcatccattcctatactgatagacatttggattgtttctacttttggctcttatgatgaataatgctgttatgaacatttatgtacaagtttttatgtggccatgttttcagttcttttgggtatatatgtaggagtgggattgctgggtcatgcgctgactaggtttaacttaaaattttttaatataaattaaaaaatgttttattttttattaaataaacagagatggggtttcaccttgttgcccaggctggtcttgaactcctggactcaagcaatccacctgccttggcttcccagagtgctgggattgcaggcatgacctaccatgcttggtgtatgtttaacttttttttttttttttagacaaggtttcactcttgttgcccaggctggagtgcaatggtgtgatctaggctcactgcaacctccacctcccgggttcaagtgattctcctgtctcaggctcccaagtaggtgggattacaggtatgtgccaccatgcccaactaattttgtgtttttagtagacatgaggtttcaccatgttggtcaggctggtctcgaactcctgacctcagttgatccacccgcctcggcctcccaaagtgctgggattacagttgtgagtcaccatgctcagccttgtttaactttttgaatgtgatctatttgaagttaatttctgtgtatggtatgaggtaagagtttaagtttatttttttgcatatggatatccagttgtcccccataacgttttttaaatcatgaatttgcatgggattttgtcaggtgttttttctgcatttactgagtgagctattgaactttctgagtattactgtcgaattatctatttctcctttcaatttcatgagtttttgttttacgtatttaggggttctgttgttcagtgcatatatatttataattggtatttcctaatgtatttacaattttatcattataaaacatcctttgtctctaattatcgggggaaattcagccagatatcgggcaaaattcacccccaatatttcacgtaggttcttttctattttccctaagcgctggccagtttgagaaataaagggacagagtacaaaagagagaaattttaaagctgggcatctgggggagacatcacatgtcggtaggttcggtgatgcctgccgagccgtgaaaccagcaagtttttattagtgattttcaacaggggagggagtgtgtgaatagggtgtgggtcacagagatcacatgcttcacaaggtaatagaatatcacaaggcaaatagaggcagggcaagatcacaggaccacaggaccaggttgaaattaaaattgctaatgaagttttgggcaccattgtcattgataacatcttatcaagagacagggtttgagagcaactggtctgaccaaaatttattaggcaggaatttcctcatcctgataagcctgggagcgctatgggagactggggcttatttcatccctacagtctcaaccatagaagactggcacacccaagggggccattttagaggcccaccctcaggggcacattctctttctcaggaatgttccttgctgagaaaaagaattcagcgatatttctcccatttgcttttgaaagaagagaaatatggctgtgttccgcctggctcaccggcggtcagagtttaaggttatctctcttattccctgaacaa

SEQ ID NO: 450 - DNA, 8000 bp, Homo sapiens
  Locus number 62 genomic DNA region, Feature name ha1p_07131
cttttattctttcaagcagcacttgatattcattttaaactggctttgctgctcaacaatgttttgtttgggagtggtgtgtgcatgcatatatgttttctagagatatgtcagattgtggaaagtacagggagcatggcgttaggctctgtgcacaaggtgagaagttcagccacaccattgtgtttctctacacaacatcaaggaaccagataccaggcctggatgaagcccagccttggaaattggaagatgccagcccccttcagttccttaaacaaggatccctggattgtaatctccacaagagcagggcatgtctgcctcatctatcattgtatctccattgccaacctcagtgctgaatatctgtggggtaaatgaaagcatgggaatttgaagagccacccatagaaactgtttcctcaagctatccctccttttcagtgttcacagaacccatactttgctcagaagattttaagtttccatcacagctgatgatggaaagtttgggcacagcatgactttgtcttttgttcagatctcacacaaggctgcagttgagttattggctggggtgtgttctcatctggaggttcgactggggagagatctgtttccaagctctctcaggttgtgggcagttgggactgagggcacagcagtttgttggctgttggctggaggctgctttcaggttctagaagatgcccacagttccttgccaggtgggcaccctccacagggctgcttaaggtatcaagctagccaggagaatctctggcaccaatctactaagacagagtgttttatttttaatttttttaaatttatataaatgtatggggtataggtgtaattttcttacatgaatagattgtgtagtggtgaagtcagggcttctagagtatctgtcatcctaataacgtatattgtgcccattaagtaatttctcatcatctatccccttcccaccccctcacacttctgagtctctattacctatcattccacactctatgtccatgttctcacttataaatgggagcacattatttagcttccatttgtaagtgacaacatgtgatatttgtttgtttctgagttgtttctcttaagataatggtctccagttccaaacatgctgctgtgaaagacgtgatttcattctttttataactggatggtaatccattgtgtacatacaccacattttctttatctcttcatccatcgatggacatttaggttgattccacatctttgctatcgtgactaaacatatgagtgcaggtatgtatgtttttgatataatgatttcttttcctttgcgtaagatacccagtggtgggattgctgatttgaatgaaaattctatttttatttctttgagacatcgccatagtattttccacagaagttgtactaatttacattcccttcaacagtgataagcattcccttttctctgtgtcctcatcaatttcaaagtattttataaccgaatcataggagtgacttcccatcacctttcctgcattctactagttaaaagcaagtcacaggtcccttccacactccagtggaggggaccccacaaagatgtagacaccaggagctgggaccctgctagggagcataacttctgccagttgtctggggtcattgaggggatcatctctttcaggaaggttcatggtttcctgtgctcatctccatgttatgttggaaggagggaaatctctgctactctgaattcagaggaggggttttcatggacatttttggggttgaaatcagccaagcatctcctgtaggcactgaaaccagaccattggcagtccaggtccccaggaagctggcatgctcctggaggagacatatgataaacaactagatcaatacatagagatcatttcagctagagatgatgtgtgaaggaaataagcagagtgatgtggtacagatcgacaggcaggggcagagcctccagtggagtgataggcgaggctcctctcagcaggtggcacatgacccgctctgtgttggggggctttggaacacatcctttcctgtctctcttgccccttccagttgtgtcattcagcctcagcagcagcaggagaggctgatctgccgccaagcagttgacatgattatgcaagtctttcagcaaatgagctgtcttttttgtagtcagtagtcaggacccccaggcttctatgccacccatgcctttggatttctgacacatttcctcaacactagcatgtgtccagggtcctcagtgccacagtccctcctcttgggagacaggtttctgcttaacattttatacatcctggaaatttaaatatttttcaagaggccaaaagaagaacaaccgtaataagtgagtgtttggtgaagaggtgccagatccagagaacatggctggtagggagatattaagccaaggagccctctgacagctcatcctgtacctggctcacattgtccatactggctatggacagtctgtgttggagggagcacgctctgttcaccctacttaccctgttggtgcaggaggtatcccccaccctaagttgtgccaggtggttggaccttcaatccctgtcactgagaggtgatcaggggctcatctcttttatgaagcttcacggatccacagcatttattagccacatgtactcatcacccagggccgtgcagggaccatgtactcgggagcagagggagctggcgggggctatgggaggggcaagctttgcagggacaagaggctggtgggtggcttctggtcccttgggaggatgggattggcttgtttgaataatttgttttttgttttcattttttgagacagagtctcactctatcacctaggctggagagcagtggtgtgatcacggttcccttcagctttgaactcctgggctcaagagatcctcccatctctacctcctgactagctgggactacaggcatgcaccaacacccctggctactttttaaattttttgtagagatggagtcatgctatgttgcctaggctggtcttgaactcctgggctcaagcaatcctcccgccttggcatcccaaagtattgggattacaggtgtgagccactgcaccaggtcttgtttgagtaattttgtgggctgacagggaggcgtagcttgaggatcaggtgggaggctgctggtctcgctgataaaggaactggccaggtgggggcctttcctgcgggggtcagggcacagctggtaagagctgggaattcagttaggcccctgaggtgcaaagctgctgaggatgtacatgaactttcaggcttcacactacagggggtttatcactgtagggaggttagcagcatctccagccccttcccccaagattcgagtacccaccccccattatgacaacaaaaaatgtctccaggagaggtgggggccaaatatgatttggttgagaaccagtggtccaggttgaccatattctggagtcagcacttgcagctaggtggtcatacccataggatgcttttgggggcttgctgcttccatgaggatgatgtaaaacttctttatggtggctcccaggagcctctgcaccatcaccttcgccacttcatccaccatgtcagttgcgtgagtccctggcctcacctgatggggctattcatggtcctaaactcattacagtttttccagtttcagacccctgctcctgtgaacccctctaatccatctccccctctcctgcttccaccgttcaccgagctcctggtgacccaccaactgtacgctaagcccttctcccttgaattcacattgtccattgcccttctcgccacagaattcatggttaacgaaatttcacctactccttgagacagagcctctgaatcagaggcctcatgactggattgtctgttactgcataaatacagagacccacggggtgtcaagtcttgtcttagatgctgggaccacagagtgttgtggctgactgtttatttgacactctcctccagtggataggccatgaggtgctggaagtcagggactgactggggcatgtttttctctccttgctgtagtagttgctcaacaaattctaactgagtgaacaaatgctctgtcttctgcaaaccttggctgtgctgccccagacttctctgccttctcttcctttctgcctggagaaccatttgaacatctcactctcttctgaagcccaccacaaaatccttctgccaaccttgttttcactgggcatttgcaaatgccactgtactgtctttcatagtacgtaattgtgtacatgatttctccttactgaactccaacttcctcatgggtagcgtattagccagggtttcctaaaggaacaaaacaaataggatagatgtatacatgaagcagagtttattaggagaattgatcacacgatcacaaggtgaagtcccacaatagaccatctgcaagctgaggagcaaggaagccagtcagagtcccaaaacctcaaaagtagggaagccagcagtgcagccttcagtctgtggctgaaggtccaagagccctggcaaaccactggtgtaagtgagtccaaaagctaaagaatctggggtccgatgtttgagggcaggaagcatccagcacgggagaaagatggaggccggaagactcagcaagtcaagtccttccacattcttctgcctgctttattctagctgtgctggcgctgattagattaggcaccctcactctcggtgggtctgcctctcccagtccactgactcaaatgttaatctcctttgacaaggccctcacacccaggaacaatactttgcatccttcaatccaatcaagttgacactcagtattaaccatcacaaggtgggacaaggccttatacttccttaggtcccaacaacctgcagccttgtgccaggcaggatggctgagccagtgcccacctgggggcctgccctgtgagcctcactctcttttctctgcttgtcaagcaactggtgtagactcagaagtttctggacccctcccagctttgtgattttgagactctgtccctgctgcaggaaggtgttttgggcccttattcagttgctgcatgaccctttatatgggtttttgtgtcactttgactgtttttacgacaagatcctgccagggctaggatgggagcatttgcatctaggaactggcatgatgtggagcttgctgagcttgatgttttccggcttgcccccgatttcagcctgcctttttggcggaggtggctttccatgagcaccccggctgggtagtaattgtcctggagctgccttgtaaacacagttaagttgccattaggtctggctgcagataaagcatctaaaccacaaatattctattgattactctctgttatgggtaatgcagggttttccttcttgtttttcctatgactgaaaagaagagttgctggaaactaaaggaagctttattgttctttccctaaatcaatgctgttgctttatataaaataaaggagaaaaaaataacagtcttgcaaacatttttatttgccaagttaagctgacctccagggacacaggcattctagcacttagaagccaactctcattgacacttgtttgccagaagtttctggagaaaactgtttaataaaagcacccaacaaacaagacccattcaattttctccaattatacctggagagtaacttttgctcactccatagttttcctctttgcctcgggtctttttagggctggtttaaatcaaagcctgtacaggagagaagaaaagcttcatgatctctttgctgagggtggcttacaacaaattagaaagaaatggaggccgaggcgggtggatcacgaggtcaggagatcgagaccatcctggctaacaaggtgaaaccccatctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaaaaagaaatggaatattcccgtaatattcaaacggctttatttggccttacgcattagcaattatgttacttgatttctcatagtgcagggctgtgggagccatcttccagaaatgaaccccgggtttggtttgtttacttttgactgagattcaggtttgagttcagtgcggaccttaggaagaggctgggctgcttccagtcccttagctgcttgcatcagatcaagtactaaggtgaagcaggtggctcctcggtgctaaatttaaggaggcgctcactcttggggctgagcgatcagtgaccctgcactcctctgagactggagcctccttaaaagtgaggagcctcctcacctcccttgcccctgtcctgttcctcctcagtctgagttttggaagggattcatgggagtttgattgactggttaattcaatctagtctggttttgcatagaccaaccattgacccttgggatgtgcaaattactgggagtgggtagagagaagggcctttctcctagggcattgtgtagattgtggggtgaaattaaaaaaaaacataacaattcctctacctatgttcgggttgaattgggcctccttgcctcagattcctgtgctgaagttctaagcctcagagcctcagacatgaccttatctggaagtagagctgctgcaggtgtcatcagttaggatgaggtcctgctggagaaaggaagccttcatccctaaggactggtgttctgataaaaaagaggaaatttggacagttgcacacacagggagaacagcatgcaaagatcagagtgatgctgccacaggccaagaagctttcagaaatcgagggagtgtatttgtctgttttcatactgatgataaagacctacctgagactgtgtgatttataaagaaaaagaggtttaatggactcacagttcctcgtggctgggaggcctcacaatcttggcagaaggtgaaaggctcatcttttttttttttgaaacggagttttactcctgttgcccaggctggagtgcaatggtgtgatcttggctcaccaaaacctctgcctcctgggttcaagcaattctcctgcctcatcctcctgagtagctgggattataggcatgcaccaccatgcctggctaattttgtatttttagtagagatggggtttctccgtgtaggtcaggctggtcttgaactcgtgacctcagatgatccacccacctcggcctcccaaagtgctgggattacaggcgtgagccactgtgcccagccaaaaggcacatcttacatggtggcagaccagagagagaatgagaaccgagtgaaaggggtttcctcttttaaaaccaccagatctcgtgagacttattcaccaccaggggaacagtatgggggaaaccccccccatgattcaatcattccccaccaggtccctcccacaacatgggggaattatgagagctacaattcaagatgagatttgggtggggacacagcgacagcatatcagggagcatggccctgcccagggcttgatctcagacttctgcacttcaggaccacgagactataaagtcacattggttaagcccctggtttgttatgacaggcttagcaaagtgacacaacacattgatccagaagcatctccgtgttgatcaccaggcagtttccgctgtggtgtctctgcttctagtgggcttctcatgtggctgtgcaattttgttgactgttctgattgtaccgtaattcatgtctttcatggtgttgtctttgatggctatcctctcagcgggagatgttcccctgatgtgtgacctgga

SEQ ID NO: 451 - DNA, 8000 bp, Homo sapiens
  Locus number 63 genomic DNA region, alpha-2 catenin, alpha-catenin-related protein, alpha N-catenin
agtggatggaatagggcaggtggtataggcttgtggcagatcccggagaagaaccaatgccacttgatgttttttttttttttattccatggcattccctgtgtgagactgtgcatgtgtgcttatgtgtgcatgtgtgttctctgtatctggagtcactactacaagtttttcagagcaggggttggttctcattataatcacattaacctccaagcatgcactctgatgccaagctgtaggattccataaatgtttgatgagaagtttgtttgtttttcattcagaacattttttttattattaaaagctccaaatgactaggaacaaagtgcttaatattctccagcaactccacccagtcagcacatcaaaagttaccaaaaagggacaagagaaatcaaagagatgcaaatgaacataatgtcaccaccttgcctttattgtacttaaaaaaaaaaaaagattcagaaaaattttctcactaacacaaatctgttattcattaaatattggtgatgtggacagggacatgggacatttgtatctgtgcaagccacaacttaggccttagctcctctcctgctagagttcagaaatctttggacatgattgttaagatttgggtaacaataaacccaaaataactggatttacctttattttcctgcaccttcccttcaagaacttcagccttttatattcttcccaaatagctatagaagtcctcagaggatctaagttgtgtttgtaaaatcagccatattgacaactacatggatctttgactttttcttcctgctcccgcagaacaccgtggtgaaatttgcagcaccatccggtgccaaatttagcatccaggtcactggtgccacggaaagcgttgccactgatgcttgtgccgggaaaggcacctctcctctgcttcagtgtccatgctaagggtgctcatacccaaggctgcaggtgccattgtttccctctattagtgtctccaggggcttactgaagggtcttttcatcctgggagcagcctatggtcttgccctttctcagtatttgtcatcctgccttgcctgagtgccattacttcagagctaagaaagaagatgctcagtggttttaattaggttaaactaatccctcctggtatgttacccttccaggaaacctaatgcctcacactgacaaaaatgcacccagtggatcttaaaaagtagtagagattatgccaggcgttggcctcgtttgaaaggaaggatctggcttttcctggaaataataaccgcctgttttctctttgcatcagatcagctccctcttcttcctcactgctccttcttttcctgacctccattcctatggattagctaattagtacaagcaccacatagatgaggctttatagcaagggtagaaagagcagatgatgttgggagcatggagaatgatatagctaattaaaacaacaacaacaatattcaacaacaacaaaaaccagcagctgcctcccttctgcttctggagggaaaactttgaatcattttgtgaagttgattgagatgtacagagcattggaggaatgaatagtagtattattacattcaaattacatggttctccctgaaatatgagagtgaatatagtgtaataagaacacaaattttcttcctgactcaccacttccaaactctgcaaccttggacaagttactcaccctctctgggcttcagttttcatatctatcacaaggagaaaatactagtgtctgtcccatagacttgttagaaaaatgtaaacaaagaaagacctatgtaatagaattgtagctgatacaacattagtactttataaatattagctatgacctgaaatttgccattataattattatttaggcactgccacccacatttagttctgcagtttatgtggtttgattatttttccctagagaaggctcatggctttttggctattaagcattttttttcctgttggtattttagaaagatataaaatggcatctcagaagggcctctagctattggaaaggtgaatcgcccgttggtttaattagaagagatattttcaggtggtgccctgaaaaatgagatgatgttttttgaagagctactgctaccggggagatagcttatcacggtgtgggtttccacaatgccgggagctaagttccaggaataaaccgagctaagaaatatattctgagtattgaatgtgattacgaggggtagggagcctgaaaacatgtgacattaaggcaattttcttagggacagaaagtcatactctattaggtcttttggcctcataaagtgttctaggcctgtatgggtattttgtgtttgtcagggtggacaagattgtgctgagaaactacctaatccccatcccagtggcttaataacacagagttatttctcactcctaatacctgctgagtagaagcagctgcaggggtgagtcctatgtgtctcctccacttatcagcccagatctccaggctggtggagcctccacctttaataacagccattctcaaactttttaatttcctaaattcctttacattcttaaaaaatatatacaagacatttgttcatatgatttataactatagatatttactgtattatgcactaaaactgagatgtaaaatatttatttactcatttaaaagtaagtatatagccaatacatgttgagataaataacacttcatggaaaatgaccacattttccaaaacaaaacaaaagaacgactctgttttgcatttcctggtctctttaatgtctagcttatttaaggacagctggattcccatatctgcttctgcatttaatctattgccacatgcttttttgcttgaagagaaaacctaggctttcacagaaatgtgattagaaaagaaacaatctcttggacccctataatggtcttaagaaagctcaggggtccttggatcacagtttgaggactgctgaagtaaaacttttccagtcactgtggctgaaaacaggagtgatagttctccagctctttaatatcagaaggaatgtaagtcgcttttgcttataatttgttgcgtacaactcaccacatgatcaagcctaacttcaattaaggctgggaaatacgggaaaacaaatggagtaattaatgaggaacactgtttctgccacaaaatcatctacttcatatcttggtagtccttcctttccttcccacctccctccccagttacttgcttgccagtgacttcttcatttcctttccttttcttcttttcttttttaatgctgacctgtagagtattgaaatcaaactcaatggaagttggttcagaaaatgggatatcagggagagctgaggcagattggcaagccttgagctgcctttattgcaactgtgtgacaccttcctcttgttcctttgtatctttttcatctactcttctgctgtagctgtgttcccttgggctattttgaccctctcaaaattaaaattctattggcattttttctgtctgctcacattcaaatccatggtttgccagacattgtattcacatcaactatttcctcaaagcagttctcagatgtgaagtagagatgattcaccttgggcttctggaactttcagcatccatgtctgcctgaggccttctgttatccattgctctaggccactattgcccagatattagcatgcatatgaatcacctggggctcttgtaaatgcagattctgattcagtaggttgtagggtgagactgagattctacatttctaacaagctccaaggtgatgtggatgctgttggtcctggatcacattttgagttataaggctgtaaacccaaccccaacatatatatcctctggggagccattcctcttgatgatttgcctcttactccagaagagactttggctaatcttccaaatctagccaatcatttgaaactcactgtgaatcccatccgctacacactttgtaccaccaacatacttgaagatgttcaagtcctcacgttagaaatatgatcgttttatggtttctaataattgcccagaacttggtatgatgaatcttctttcctactttgcaagtagctctcttaaaatttgctgagagtctatcatttttcagttgtatgcatttacttacaaatacaaatttggatttctaaggttcactttccttatagctggtaatctctcttctgtgcctgggcaggtgctccatgtagcaatctaggcttaggagaaaggagaaaaaggtaggttggtttggtgctcacacatcatgtccccttttaattctggtgctagtggactagagaaattgagaaggaatagattagagtctcctcacttgacatggctgagcttcgctcctcattagccatgactgctcttcagcctcactatctgcagactcagcacagacaggtggtgggtaccacacgcattgctgatgaggggcacatctgtgaacagctgcctagttgtggtgatccctttggccacatccttcagttggcagaaccatacttactttctcttaaccctcaaactagagttgtattagaaatacagaggcccccaaatttaccttctcagacctttaaatccaagcaacatctgatgttttatcttatccaaaatgaagaactcaaaagaagggagaaggagaactggtacttcttgctctacccctctccatgagactttctgtccctatttctggttttctcactctggtggtataggacagatcagctagttcactggctaagatatacactgcaaagaggaatagaatgtaaacattctcttttctttccttgttgcaaacttcctcaatcttttcaggttatcctcttcatctcagggtagaaaaatatgttctttcatcctccataagaggggatgaatgaggcaaaaatgcatttaataaagactacagtttccaaaaatgctcctacctttctcaccactctgtcatttatattgaacaggaaagcgggggcgtggttggtgtgagaaagggttctttgacaattctcagtaagcccagcaggaatggagctatctcatgggtcctacgggaccctgaacttcaaggggaatttagttcctttattctcaacactgggcctttaacatgagtgcacgacaactggaaacatcccagttgactgcctgttagatgtgtgtatgtgttgcatcagatctgatcatcagttgagtgaagattcgtgaccatttttttgtttatcaaaaccgtatcaagtggaacttgggcaaatgaatggtttctatttttttttctcagctgttctggtgctgtgtacactgtcagaattaggtcaagggaaggtagttattctaatttgctaacacttgctgtgtctgagaatgtttaatgcaaccacagagaaaaaacagacatgtttaaaaggtatggtatgtctgtgacatgtgctatcccttgacacatttgtgtcacaggtgccgattcctgcagtttactggtgttccacacttcagttctgcaactgcaaaaggtgatgagtagaggttgtgcttgcctcagctgggggcagcactccccaatcaaagatcaagcatacagactggcaggaaatttaacaattccctttcccattcatggaaattcaagctcttttgtcatcatattgtttttatttgtatactatatagcttgctgagcctctcatgagattttgaatatgaaactgatcaattaggtaaaaagcaacttaatttttaaaaaactcaacctcgtcaccctgcatcacttcagtgtggtgctattgaatgcaaatgtcagaaatagcctcttccacccgattaattatgaaccaaagagatcatcagagagtaaggttgccccaaggtctgtgttccttcttggcctctgtccatcaatcttctggatcagtggtcttcaagcattttgactcaaacacacccccttaaagagttttgaaataccatgtactgtctcatacattttaacagaaaaattttgagataatcatctattcacatgcatttcacatgtcataaataatacaaagagacctgtatgctctttccctcgtttcgcacaatggtatcatcttgtaaaactgtagtacaatattccaaccaagatgttgtcattgatacagtgagatacagactatgtctatcactacaagtatcactcatgttgctcttcaatagcaacacccacttctctgccagcctcatcccctccttaacccttaacaaccactagtctgttctccattgctatagttttgttgttttaagaatgtcatacaggccgggcatggtggcttacgcctgtaatcccaatactttgggaggctgaagcaggcagatcacgaggtcaggagatctagaccatcctggctaacatggtgaaacctcctgtctctactgaaaatacaaaaaattagccaggcatggtggcgggtgcctgtagtcccagctacttgagaggttaaggcaggagaatggcgtgaacctggaaggcagagcttgcagtgagccgagatcgtgccactgcactctagcctgggtgacagagtgagactccgtctcaaaaaaaaaaaaaaaagaatgtcatacaaatggaaccatacagtccgtgacatttggggattgggattccttacttatcattattctctggagattcatgcaggttgttcagttggaccattcacccattgaaggacatgtgggttgtttccaggtttgggctattatgagtaaagccacgaaaaatatgtgtatctagtttttgtgtgaacacaagacttcatttctctgggataaatgcccagaagcacaatttgcatgtttagtttttagttttgtttgtttatttttaaataaactttattttttagagcaaaatttcaggttcacagcaaaattgagaagaaggtacagatatgttccctatatcctctgccaccacacgttgtttagttttttaagaaattgccagattgccttccagattagctgtaacattttacattctcatcacaatgtatgaagtcatcctgtttctctgaattctcaccagcatttggtgttttcacaacttaaacaaaaattagccattctgataggtatatagtgatatctcagtgtggttttattttgtgttttcctaatgactaatgatgttgaatatattttcttgtgctaaccatatatctccttgcttggaatgtcccttcatatcttttgtccatttctaatttctcctgcctcagcctcccaagtagctgggattacaggcatgcaccaccagagctaatttttgtatttttagtagagatgggatttcaccatgttggtcaggctggtctcgaactcctgacctcaagtgatccacctgcctcagcctcccaaagtgctgggattacaggtgtgagccactgtgcctggcccgtaacttcttttttaatcctcttaacaggacctttcacagagcaaaagttttcaattttgaagttcaatttatgtacatttcctctcatagattgtgtttttggtgtcaagtctaagaactcctttcctagtcctagatcctaaaaatattttcctatttttttctaaaagttttacatttttccattttgcatttgagctgtgatctattttgtgttaattttatgtaagatgtaaaatgtaggtcaggcttcacttctttacctatggagaaccaattgctctagcaccatttgtgtaaaaagctacctcttccccatttggttgattttgtacttttgtcaaaaatgtgtccatttctgggtcctctgttccattgtactatgtgttgatttttccaccaatatgacagtcttgattgctgtaactataaaataaatctcaatattgagttaaatagattcttccctcttt

SEQ ID NO: 452 - DNA, 8000 bp, Homo sapiens
  Locus number 64 genomic DNA region, Feature name ha1p_08588
agtttctctcatgaaatatgcacagcaagcttcacaactaatgaggctacaggctcccaccttccctcatcaacatggaaatgtttaaggacagtgctacttctgtgtgctcctctcgggcaattccattcctcttctttctgcttcttcctctctgtggacaaaacaggggaaggacgagaagagacactccggttgccaagagcagagacttagaagagaagggcagaatctcattgtgctgcaaaatagttatatgactctgcacaccttgggagcctcagtttatccttttgtaagatgggggtgatgatgcacaccacacagggatggttatgaatgcccacaagtagcaagcatccacaccaaagtattcagaaaaagatggatttattgatggctgcagccagaaaggacaccagagtagctcacagcaccggagaacctggattctaaatcctcccagttcccccacatgggcccgcaaactcttggtttcacttcccagtaggctccacgagcaactctgactcatttctcacacttagagacagagaaaatagaaatccccactcctggcctccatttatcaatcccacagaagggttctagtgagccctgtgttatggcttggctctgtgtccccattcaaattttaatctccaaagttgggagagaaacctggtaagaggtgagtggatcatgtgggcagatttctcccttgctgtttttgtgatagtgagttctcatgagatctgatggcttcaaagtgtgtagcacttcccccttcattctccctctctcctgtcatcatgtgaagatgtccttgcttcaccttcactttccaccacaattgtaagtttcctgaggccttcccagccatgcctcctgtacagaatatggaactgtgagtcgattaaacgtcttttcttcataaattacccagtctcaggtagttctttatactagagtaagagtggactaatacaccccataagggtcactgtcacttagaggtggagctgagactggcagatacggatgaaagtagagaggggctgttctcctaagagaaaggggattgtaaatctgctgaattaatcccaaactggaaccgccctcctctgctccaatttggatttgatgaacttggacacgtgaaacagacccaggctgtcgggacatgtgtgggactggtgggcctggggcggggtcaggctttagacaaggtggttccagatgctcaggagcaccccctaccatggacaacagagcagggatgcacacctgggtgcaggagcatgtgccaaacatgcaggagcaaaacatgcacaagcagaaaatggtgccaaggcaagctaggccagagtggatgagatgatataggggtgagtccaggtgaagcccagcactggcagaagagagcagaaggcacagagagaagaacggcctcggggccagacagagtttagggacaggtggccggagatgggggcagccatccaggcatctcctggtcctgatttctctctctaccagcctctgacccagatcttaaagaggcaccaaaggggctcccacgcatggtgccaggcacatgagcgtgctcagaacgcctgcagtcacttcctctgagcactcaggaagagggagtgcacacagggacaggggatcgtgtgcatctgtactgacgacggaatcccagcaggacaccttcactcacttcccataaccaacagcaaatgccatgcatctttgaaggagcaggagaaaaagctgcatgttaactctgtcattttccaaaattaccagaccaaagatgagcatgaaatatcttttcgctgagataataaaagtggacaaaaataaataccaagcctgtgttattactatttacccatctgacactacataagcctattttaaatggcaatattgatcaaatatctatgacgatacctagcaagtgattcattgcctaaaaggctacactgcttgaatttgatccattctatcacattgtattaattagacatataccattaaatattaaatcatctctgcctacataatttgtaatgcattgtttgaaattgtatttgtaatatatccacagacttatttgctgcaaaataaagtctatcaaatttcatcatatagataatatagatggttgactgtaaaagaatgagaaaatatggctgacttttccataaactaaaaggcacgcttgcactcataaagaaataaatagttattgcccccaatgtgaaatcagtttctttgagatgcactacatgtagtcactggccgggaggcctggaccatgtgatgtctcattttcctcacaattactattatgtagttgttgccagtgcagacattccctaggaaaatcgctttatttaatactagaattacatcacattaatagtaaatttaaatttacaaacaacatataatttgcttatttcagcattgtacctgtttttaaaacagacaaaagagctggtcttttcagctactgaatacttggatttttgtatggtatcggggtaagagccctgaactggggattaagagaaatgcctttgtttctgtttgtgtctgttttattgtctgtgcacaatattcactaactcactatgtgaccttgaatgagtcttttcctctctctgagacctactttcctcatctgtaaaggaggtcagcttaggtggtcatgaagtccccttctcattatcacatcctgtgtctctatttgaggaaaggaatggctattaaatgagattacagaaaaaataaagtgaccatgggaccccactgctgtatctgcaaagcaaaaacattttggattttgttaatcaaaatgcttctctctttgtctgtcacttgtctttgaaatcaataaaacagagcttcatgaaggaagcattcacgcaatgcccaccgtgggatgggaacccccttacacactggcaatatggcaaagcagacacagacattgagcctacattgtaaggaaacaagaaaaataaatgagatgcatagaatgtttttattgctgtgaagcaaattatcacaaactcagcagctggaaagagccgtcttatgaactcattgtcctgccatcaggagtctggtcaagctggctgggttttctgcctaggcttacatgaaacagcatccagatgtcagtcgggctgtgttctcatctggaggcttgactggggaagaatccccttccaagcccactcaggctgttggcagaatttccttctatatggggataacttggttattcaaagttattcatgatgttatcaaagattctgtttttccagcaaacttgctccaggtggtcacttccctagagtgagtctgctgggaaaatgcagtctttcatgacatcatgcactcacaagtgtggcacgacatcacagccagcccactctatagggtggaagcaagacacaggccgtgtcacaccagagggctgggttacaccaggatctgaacacaggaggcaggagccatggggacccccacagagtgcccaccacagaccaggaaggtgacactacatccaagactggaaggaggtaggggcatcattacaactgttgggcatctccatggctaaatcagccagtgcagtgtccccaagggaggagctggtgcagtttgtctgggaagagctggggctgttgctgctgaagagaggccagaggtcagggataggacctaggagtgggggtggcaggggcctgtggtgcaggactggtgcacctcaggacctcattttttgactttactgtaaatgaggtggggcccttggagggtgccaagctgcaggaaagcacagctgccttggctttccaagggcccctctgagctgcaggagggcagggccagagcagaaaggccagatgggcactgtacacaccattccacagaggatactggccctgacagggcaatgaccagtgtgaggtcaagggatgtcgtgctcagcttgatttgggaggtggcactgacggggtttgcagatggataagaagtgagtttccccagtgtcaagaccctataaccctgcagcccttctctgcctctgggatgggatctaaagagacccttctaatggtgtcctgccgtatcctgctgtgggcacgtggccccagtccttcacagccccacactgtgtctcaccttggggttcctgttgctgaataaccctcaccccacccccttaccctgcatcccgcaggcctctgacaggcgtgtgtcattcatagggtgcttctcccaggatgctgccaggcagctagaactgcctgagatgctttcctcaacccctctaggtagaagtgagtgtgttcttcccacattcacaccacacactgtttttcacttgacatggtcatctgatggctcgccttccctattcctaagcctctgcccctagtacagtgcctgacacagacactcaccaaatacgattatggagtgctaggcagaagggtccacgtagcctcttgatggccaacccagctaactcgagagctgggctttagcgggaagcccagtgaaagaaggaaggttttcaggctgctgattggaggcaggaagtgttagagcttgaacttcagtaccaacgccggaggcctgctcagaacttgcagagggcaggggagcccggtgcagtgaatctcagacagcgaagacagcaggaaggacctggccccactcagcccaatctgggagcttgcagtgctcctggcagttgcaagaacagagacacaggtagaagagagatctggggagagaccagacggcccctgcctaagccatgccgtcaggaagatcagagcgagcccctgggccccctgagcagaactgcagctggagcccagggtgagctcagggacactcagcctctctgagagcccccagcgaacgtgacgggaggcccagcgcccggggtttgagggccctgtcagcttccatgtgtatagttcctcgttttctcaataggggtttcaccctctgggttgtgtgaggggatctggtttcaccaagccaagtagcagtgaactccagagcctgcttccccaagcacccctgtcatactctgggaccctggtccaagagccccaggaggaggggtgccccaaagccccaaaggcagatcaggtgcccctggggtcccagcaggcctggcctgagtggggacctctggcgtggctgcctcagccccagcaaagcacaacggccacgcagctcacacccggtcaccagcagtcacctacagcctctctgggccccacctgagaccttcctggagaggggcacaggcagtatgcccacctcctacccagatccagggctggagaggggctcccggaagggtgaggccagaggtccccgttcatccttccgacaatcaaagctggaggttcactctcagaggcttttcctgtcttccgctcctctacgagaatgccaatacccgggtgagatgatgcattaacctatttctcatggaggcgtgggtcattcatcagatcccctttccccatgcggggggcgcccagctgccaagtacacgctgctcccttcaagccagccaagggctggccgggcttgcagcttcagtgggctctgtgtgtccgggcatgtctcccactctgagcctcagggccctgagggggccctcaagggggtggatccctgagcgcagagccctcctcctcccagaaaagctcagttatgggaaggaaggcactcttgcctttgcctttcccagagacaaacctcaggctgagattttgagtttaatgcaaaatgaatgccggccagagaagaagctgccagctgctgtgtggggtttttccactcatggcttctggtcttcacctctgagaatcctttcctttaaaccaaaaccatgagcactaagaaaatcaaataagccgtggcctgggacacgtgcagtcaagggtggcgcggccgcctccagacctcaccttctgaaaggctgggcaggcgggggtgggagcagaagggcccaactcaggccgctgctgtgtctgcgtactgcgagaggaaggggatgccccttgaccagcatagcctggggggtgctaagaaccagactcagggtcaccctagcagagggtccggctgggtgcaccgcaggtgactccactgagggaaagacacagacgcatggggctgactcaggaaggaatgcgcagctgcacggtaggggcggctgggaagccgggcatgtctgcacctggaacaggctgggacaccagccccacagacgcctaagactcagctgcaggttctccgcggtcactctcctaccccccgcagggagccgcctcccacctatgactgctcagccagagaaggctctggaacgactcacaagcctcctcacgcgtggggtcagggcctccctccagctgtgctcaggagggctgctgagcctgtggctgctggaacccgcacttaccaagtgccctccattagcccttcccattcttgcctgaaaggaaccctgaaaagcggcaaagcatcaaatttcccccactcagtttccgggagctcatccaattctctacaggagggtggccagctttgggatcaggataccaagagccactgtccggaggctcagtcacctgggctcaccctgagagttggcataggcccaggcccacctagcctctggccctgcaaggcggagggatccagaaccagggcaggaatgcttccagcacactcagggacccatgggccaccagggtgggccccgagtccccactcaattggccaggccagcaagcatggatccactccagaggagcaagcatggatccactccagaggttttggctgtcagcagagtgagccttgggagccacacaggacttgagaccccttcaacctggaaggccttgaagagcagtggggggctctcagccttcctgagattaactgggtctctcctgacctgtgagcagataaaaatgagaaatggtcacttctggcctgttctgtctatggaaaggacttctcacaagaaaggactcaaagtgacctttggaattcatttttctcaaaataaataaagccagtgaggtcgcgcagaggaaaaaattgcagagggaatctggaaggagggaaggagggagggagaattcttcctgttctgaccttgagaacacttttggaaattcagtcatgcaccacaatctctctgtcaataatgagctgcgtatatgatggtggtcccatacgacgatagcaccatatttttgctgtaacgtttctatgtttcgacacatgaacagtggccactgtattacagctgcctgcattattcagtgtggcaccatgttgttcagacttgtggcctaggagccacaggctgcaccacgtggcccaggcgtgccgtgggctgaaccatctgggggtgggtaagtgcactccgtgatgtctgcacaatgaggtgcattttgcagaaggcttccccgctgttaggaaccgcgtgcctacgagcaccagaaaagtgtcccttctaaccagcggtcaggggccgctggtgataaccacacgaagacatcctccccgacattcctgtggccaaagagaaacgtagaggacagagcctactcccagggtgactctgtggcactcaggcacgtaggacacagggagagagaggctggaacgtccctagcagaggcctgagttggaggtgacacctgcacagtccttcacacaagcaccttgctgcttctgacaagcccgtgcccctccacacacagggaacccaggtcaaacctgctaacgcgataccacgtcccatcccaagaggcacttcggaccctgcaaggctgccaggcagccccagctgccccccacggtgcaggctgagccaggcagtcctctccctgatggccagctaggggtggttccatggtggc

SEQ ID NO: 453 - DNA, 8000 bp, Homo sapiens
  Locus number 65 genomic DNA region, sclerostin domain containing protein 1 precursor, ectodermal BMP inhibitor, ectodin, uterine sensitization-associated gene 1 protein (USAG-1)
tgaagagtaccaaaaaagcacctttctgaaatgttactgtgaagattcatgacaacatattttttttaacctgttttgaaggagttttgtttaggagaggggatgggccagtagatggagggtatctgagaagcccttttctgttttaaaatataatgattcactgatgtttatagtatcaacagtcttttaagaacaatgaggaattaaaactacaggatacgtggaatttaaatgcaaattgcattcatggatatacctacatcttgaaaaacttgaaaaggaaaaactattcccaaagaaggtcctgatacttaagacagcttgctgggtttgatcaaagcagaaagcatatactttcaagtgagaaaacagcagtggcaggcttgagtcttccaagcaatcaaatctgtaaagcagatggttactagtaagtctagttatgggagtctgagttctaactcatgctgtgcttgctggatttgctggctcttttccgctctctgtgatgctggactggcttggcaggtgacatgctctcaaagttgtgactggactcgttgtgctgccgggtgtacctcttgcacttgcaggcagtgactactgtgattttgtaggtgcgtgtgctgccatcttggcactgcagctggattctctgggtacgggttttgtcattgacacaccgccactcctgggagctcctcctgctccagtactttgttccatagcctcctccaatccagttagggagcactggcaggggcaagcactcgccagcacacaccagctccttcagagggctgatgctggtgcactggccatcagagatgtatttggtggaacgcagttcccggcaacccacttgaacccgagctgcaggaaacaaaaaagaatgtgcatcagagaaaaaatgcaaatgaagaccttttaaaaagtgatctgcaatgacaaaaataataggcaaatgatagcaaattgccaaatagaaagtgagcacctactttattttcacagtgaaaaaaatctgtctggatagtatagggacactttcatgaaaatcatcagtttacatggctataacttttttgggaaaaaaaatgtaggcctgattgtttttatatataacattagctaattgcttattagagtgtttgaaaatccaatttccttagtctgactctccaataaggggttagcagctcttccatttatgtgtaaatattcattattcaatgagttaagagtatactttaatattctctttctcaagggtcatattggctaatgtctgcaagtgtttttaattaggctttttaaaaatctgttgagaaaaaatgtgatagccatttaaatattgtgtataatgcatatgctctcggtaatattttatttcaattatagactttagctgcagagactcagacatacatgtgtacaacatctgacattttgcatatcaaacttaataactatgttttaaacataaattcccaaactatcttttaaaaaatacaaacagtaacatgtttgaaatgtaaaatgccactacaactcaagactcaaagaatataaaagcccctaaatcaggaacgtatggttgccataacaacttggctacatttccatgaattttatggcagaaaaatgcctaacatgtctgatttacaactgcaaaaggaaccacggtgttcatttcctgaatattggtcatggcaaactttttgttttagttatttggatttgataggtatgttctctaattggctgtttcttgttacatgccttatgtaattaaagcaaaaattaatctttaaatattttaagttttccttacccttgctttgttatctaaacttgaggagaattgcctataacaagcttgaaaagaaatcaaggcttgccaaccaggaaaaaaaaaaaggatgtttaaaagtacaggctgctgacattttacaaataaaaatgataagggacactgaagtggttccacaaaaagtactgaaagatacgtcgaagtagaactgaatcaggagtttcacttcatctctgtatgctagtacttctgaggtaagagatatagcttaaggggaacgtgatagttgtggaaaaacttatgtatatagacatgcatgcatagaaatctagaattgtgggattaaaatgtaaagcgtaaattgtttggttggacagtgtgctcagcgtgcctgattctgcctccagctcaccttcctgcagctgcctcaggaatgcacctggaaatagccagaaataattttgtctcgtcaagctttctgttcctgtgtatatacagatttggcatttttgcagtgacagttcattgacaacgaatacccaccacattgctcagtaatctaataataatcagatatgtcctgtgtacttaaaagcaaccagcttcgtgaaagttaaaacatcctagctttcttagacattaacagtcaaatttgctttgacttttcaaaagtcaaaactacttttcgtagttgaatggagtgaagaaggagaggcaaaagatttgtgtaagatttcctgcgcagtgtttctctctctctctctctctctcttaaaacctgattattagcatatggcctcttctaaaggaaaagatagaaacaaaagttaggggtaatttgaatccccctaaccagtggtcaattagtgtgtcaactaagctgttgttttacatctcttaagttacaaaaatgtccccagtctgtcacagaaatacacaattatctaaattttgaatgggacaacaaggaattattttagaaaaatgtgattctccaacatttttagtttatccctcttttacattgagcatcatcaaaacttttgactatctcactagacatattttagaaatccaatgtaaacaaattttttctcctggaagcttccttttttcccttgtgattccctatatttatttgtggatggtaactaataatatatattagttacgtttatacactttaccaaaattgcatatgccctgaaataaattgacaaaacaaccggaacttgagctatctaaaacaatactttttaaaatggtcattttgcatgattttgacaaaacaatagtttaattcctggaaatgttttctttgtggatgtttgataaaacttcagtctgtgcttgcactattaaaccactgttttagttaggttaactttaaaatcactacctagggaagaatgccaacctgcacatgcagcagattactcccaaattgtttcacaacatatatacggttcaggttagttaccaataaaacaattctacaggaatgtgagctaatgctaccagaaaagaaaaaaaaaaactgtacaagtaaaacacacttactgttccgatccagtccagtgttactgaaatgcctgcctccatttctggcttgattcaacgtgctgttgctgctggggtgtgctggaacaggtttaaccacatgtgaataaaggatttctgtggcatcatttttaaaagccaaacagcttttcattaggatgcatgcaaggggaaggagatagaaatgaatggcaggaggaagcatggtgagtagaggatttgcttgactgaagagctggttaattcttttgcttctgcttctgcactgtaactgtgaaattcctcctcaagcttccctttatatatccatagaggtttggcgttcattcaggtgtaaagttgtgtagagcttcagagtgaaaacacagagaaggggtgggatccctacatgaccctgcaaaagaattttaccaatggaaaagaagactgcagaaaaggaggagcttggtatacaaattgcctgaaatttcagagttggacttcatcacttgtctgtgagccgacgcaggcaggcgtattctatatcaacgacagactctcctctgccatttcctttcctgaatctagttaacattcgggtttaatttaaacgaaaatacatcgctgttcatttgaagagactggctttcccacagttgttctgtactttcctcagattttagagtatttgggtcagaaagggagttcttcccagataacaggaggaattcatgtgagtttaaatattgcaggacttgcatgaagcacctagttagctaaacattgctttctctcaagaagcaaaccaatatttttttttccttaaagtaaaaggcacagagctaaaacctgccccctggacatgcttaaataatgcagctttgatctacaagaactactgtgctgctaggtaaattattgccaggggttttgtgtggagaataatgagcatagttctgtctacattaaagtaagtaatactcatttttgtcttaaaaatgtgtcacaagcattaatatccatagcattgttttacataaagccatttgtgacagactttttagcggattcaaaataattttttctagattttttcagaacacagattctactcgtatttactaaatattttgctcattacttcctttgactctgctgcccaagtaagaaacctatttttctgaattactttaccggcacccagaacacgtgttccattaattaattataggccactgatgatccctttaaaacaatcataaaattctatttcatcatgggacatctcaattggaataactattctgaatcatcttttcaattataaatccatttttgtcctttgtgtggttacctaaatcacctaattttgtatctcttttctgtataagcttttgtcccttgtaactgccatttgcctatatgtctgcctacctgaatttctccatagcagcgctactggcattttggaagagacagttctttattattgggggaccatcctgtgtgtttatcagcatccctggcttctaacgactagacgccagtagcacccccctagttggtaacaaaaataactccaaacattgccaaatgacccctacagggtaaaatcacccccaatttaaccactaattatctattcatctatctcactataaaagaaagtaaaaataagtataaaggaaaaatattataataccaagaaattattgttcttttttaggacagaaatggtaccgtagttttgttttaaaacaatgactgcttctctattagaagtatatactggaatatccttagatgaaatgattttatatcatcttttacattatatggaataagctagaataagcttcaaaaataatatgaggaggttagaggtgtgagtggcaaaagattaattataagttgatggttgttacagtaggatggtaaagtattatattctgtttattcttgtgtatgttccaaattctacataataaaaagtttaaaaaccagagtcagacaatcagtttaatggacgtatacttcctactaacaatatatctctatcctacgattggatagtcatttattctaacatccttcctggaaaatcatatgtcagtttattttgtgcaaatggagattacaggcatccttctaaaatactaactatgaagaatttcctgccctacttatcaggggacttgatgttaattacacaaagcatgttaatattaatcattgacctacagacccaatgcctaaaggaaattaaaaggtcaaaataatctaatctgttcctcactactttttctttttctgtgtcagaagcaggagatattttaattggaatttaattatcgggttgggctaatgaggttgaccaaattcacgcacagttattaaatctgctgcacctagtattctgaaggctcagccttaggatatcacctcaggcagaagcaaaattagaagagaaggcaatgtcgttgtgcatgtggacaggacaaactcagagttcttaggcccaatttacccgacagacccctagagaactattttgaggctgggtgcagtggcttctgcctgtaatcgtgcactctaagaggccaagacaggaggatcacttgagcgcaggaattcgagatcagcctggacaacatagtaagaccttgtctctgcaaaagtaaaataaaaactagctgagcatggtgattcatgcctgtagtcccagctactcgggaggctgaggcaggaagaacgcttgagcctggggtgttgaggctgcagtgagccatgataccaccgcaacactctagcctgggcaagagtgcgaccctgtctcaaaataaatgaataaataaaaagaaagaaaactactttgctaaaatagaaataatcataaatttaatacttaacagttattctgatcagtttaaaacagctccattaaaaataaccacaaactattgcttctcggccttttggctcagatcaagtgaaggataaccacaaactgtaataacccaagaagaatggatatagatgtttaatattgaaattgattctttctcatcttcaggcattagtatgtacctgttattccctttgcttataacactcttccctcatcctcttccttggctaatcacctacttttccttccagtctcagtttagatggcaatagcactgagaaaacttgccttgtcctctcttccctctatctgctcgtctcaatccagcatacatgtgccagagcagcaacttgcctgatgacttggcaagacttatgaaagaagaaccatttctatcttatgggtattgtggaataagtggttaaattaagtatttaggaaatgtagaaaaaatattctttcattaaaaagagattggctaatatttgtggtaggcagtcgctaagatggctcctaatgatccccttctcatgatattcacatccttgtagcaatccccttttcttcagtgtgggaagaacttagtgattaacttctaattagtataacatactaacatgatgagatgtgacttctatgattaggttttcaaaaaactatgacttctgtctttctggctgctctcactctcttgtttgctttggtggaagccagctaccataatgtgtacttctccataggaaggtccatgtaacaaggaactgatgctcataaccaacaagcaactgaatgagggcctcagccaaacagatgagaattccatcaacaatgacatgggtgagcttagaagcaaatcctctcacaggcagatgaggctgcagccctgtcctacaacctgaatgcaaactttaggagagacatcaaaccagaggcacccacaagaactatgagataataaatgtttgttgttttaactaagttttgggataatttgttatataacagataatcagtacaatgttatttgtaattaagtcattttgtgaataatgctagggccttgagagcatcagatgtggaatcattagacatggtgactgtgcatcttgccatctttgggagagtgttaagacttattttctgttctcagctgtgcatcattgcaagaaaaataaaatacaaataggaaattttgttaaagacttattttctagtcctcagctgagccatcaatgtggtggcattattaataatcatataatggtattagaattactactagcagcttgatttgtaaaagctggaaactaattttgattttctaaatagtgtcatcatatgacttggaaactgaatttgaaaatctgaatttggatctgaaattgcatcttagttctaccatttacgatatgtatgaacttggatatacagttgacccttgaacaacacaggtttgaactgtgagggtgcacttatacttggattttcttccacatctgccacccctgagacagcaagaccaacccttcctcttattcctccttctcagcctactcactatgaagacaatggagatgaagacatgtcttatgatgatccatttccactcaatgaagaataaatatattttctcttccttacaattttcttaataacatcttcttttctctagcttacttaagaatagagtatattatatatatatatatatatatatatatatatatatatatatatata

SEQ ID NO: 454 - DNA, 8000 bp, Homo sapiens
  Locus number 66 genomic DNA region, Feature name ha1p_104458
cttctgtagaaaatgccaacccccagtacagggactctggcagctgaattggtgactgtaaagcctgatctatatgaaatcaaaggcacatgtggaaatccactcccagcaaagggggagtccttgggggaagccagctgggtttctgtaggatcccctctgaaatgtcagcatttgaaaaacacaacccaaaagtagaggatctacagggaactttattctctcacttctgtcttcatggagggcactgccccttgggaagaccaggttggcttctggcacaggtatcccccatcttcttgggcacctgtggcattgccagcaggccagagggggcagctggcagtgttggctctagcctgacccagggggcccagttaggatgccctctacccatggcaggggtgatggctacttctccatggttcatgcatgaagcttccagccctttccagctcagggaacacatgcagaatgacagtcacccagcagactggaaactgcctcctctccaaaagtctggctcctgaacaccctcctccctgggaagggctttagcccctttgagattgggcaggaaccagaagaacagtttctctgctttgccatgtctgcaacctagggctcacccagccccatcaagtgctgagctccagcactgtccacacagtggaaaccaagtgaaatgactttggcttgtggagggggaagaatgaaaaacaaaaacaaaagcaaaatcacctgcccacaagatagagcagaaaagttcatccactatctttttttttttttttttttttttttttgagacagagtctcactctgtcacctcgggtggagtgcagtggcatgatcttggttcattgcaacctccgcctcccgggttcaagcaattctcctgcctcagcctcccgagtagctgggattacaggcacctgccactacgcccagctaatgttttgtattttaagtagagacagggttttaccatgttggccaggctggtcttgaactcttgacatcatgatttgcccgcctcagcctcccaaagtgctgggattacaggcgtgagccaccacacccggcgacttcatccactgtctgtccgcttcctgtgtaaggccgaccacccagcccccaaacaacccttaaaatgagacccaaaccaaagacctaacatataagcctcaaatcagtaaacctctcctgaaacaggcagaggaactgcctgcccagaaatactcacaataggctgtgcagattgtaaagagatcaacagcttcacccacgctctgcataaactctggtactggctgtgttctccatagaaggtctcgctgtgttgcctgggctggagtgcagtggtgtgaacacagctcactgcagccttgatctcttgggcttaagtgattctcctgcctcagactcctgagtagctgagaccacaggtgcatttcaccactcagctaatttttagtttttttgtagagatgaggtctctaccaagctggtctctaactcctgggctcaagcgatcttcccatcttggcctcccaaagtgctgggattacacatgtgaaccactatgcttggctcaaagatttattgataataccctgcaagcacaagcgtgcaaagcaaaaatggacaaataggatcacatcaagttaaaaagctgcacagcaaaggaaacaataaacaaagtgaggaaacaaccacagaatgggagaaaatatttgcaaaccacccatctgacaagggattaattaccagaatatataaggagctcaaacaactctataagaaaaaaaaatccaataatctgattttaaaatgggattttttttatcttaaaaaagatctcaatagacatttctcaaaagaaggcatacatatggcaaacaggtatatgaaaaagtgttcaatatcattgatcatcagagaaatgcaaatgaaaactgcaatgaggtatcatttcaccccagttaaaatggtttttatccaaaagacaggcaataacatgctggtgaggatgtggagaaaaggtaacgttgtgcactcttggtagaaatgtaaattagtacaaccactatgaagaacagtttggaggttcctcaaaaaacaaaataggctgggcacggtgcctcatacctgtaatcccagcactttgggaggccgaggtgggagtttgagaccagcctggccaacatggtgaaaccttgtctctactaaaaatacaaaaattagctgagcgtgatggcagatgcctgtaatcccagctactcgggagcctgaggcagagaattgcttgaatctgggaggcagagattgcagtgagccgagatagtgtcactgcactccagcctgggtgacagagcaagactccatctcaaacaaaaaacaaaacaaaacaaaactgaaaatagagctaccatatgatctagcaatcctccctcctaggtgtatacccaaaagaaaggaaatcagtatatggaagagatatctgcactcccatgtttattacagcactattcacaatagacaagatctggaagcagcctgagtgttcattgacagatgaatggataaagaaaatgtggtacatatatacaatggaatactattcagccataaaaaagaatgagatcctgtcatttgcaacaacatggatggaactggaggacattatgttaagtgaaataagccaggcacagaaagacaaacttggcatgttatttatttgtgagagctaaaaattaaaacaattgaactaatgaagatggagagtggaacgatggttaccaaaggctgggaagggtagctgggggaggtggaaggggagatggttaatgggtacaaaaatagagttagaaagaatgaataagatctagtacttgatagcacagtagactgactacagtcaacagtaatttattgtacatttaaaaataactaaaagagtaaaattggattgtttgtaacacaaaaaataggataaatgcctgaggtgggtaggcatggtgactcatgcctgtaatcccagcactttgggaggctgaggtgggtggatcacttgaggccaggagtttgagaccagcctggccaacatggtgaaaccccgtctctactaaaaatacaaaaattacctgggtgtggtggcccatgcctgtaatcccagctgaggaaggctgaggcacaagaattgcttgaacccgggaggcggaggttgcagtgagccaagatcgcacctgcactctagcctgggcgacagagcaaggctctgtctcaaaaaaacaaacaaacaaacaaaaaaaacttgaagtggtggataccccatttaccatgatttaattgttatacattgtattcctgtatcaaaatatctcatgtgctccataaatatatacaccttctatgtacccacaaaaatttttaaaaaaaaatttttttttatacagtctcactctgtagcccaggctggagtgcagtggcgtgatctctgctcactgcaacctctgccttccaggtcccagttaagcaattctcttgcctcccaagtagctgggattacaggtgcccaccaccatgcacagctaatttttgtaaaattgaaaaggtccagaatagcctctgtgtgtacagaaggtaggagtctccatggtgacagctgatcttgggctggtcagtatgcttagaaataaaaaagcattaaaaagtatgagaataaaaaaggctttgccgggctgaggaggggcagctcataagacatcctgtaggccaaggtagaagaagctattaatagaagatcttatagtgcccccatgtggggggttggggaagcccagtgtggaggaccctaagcagagggaagttgtgaccccagataaagatgactaatgactagggacctgggctgaggactgatggagattggataagggggaaattggctgtggagtcataccttagaccctggttgggtaggaagtcaggatcgcctagatggagctatggagaataaacagagcagaagtgtagtggtctgtgccaccctgaccgtcctgtctcagtctttcccatgtgcttcttaggtgctggtacagggctgcctcttggacccttcccagcgggaggtgttcctgcagcagatatatgagcagctctgcctctttgaggataaggtggccaccatgctgcagcagcagtacgatccccagagccaggtatgtaagagagaaagtgggcagaggcaacttagaaagaggagcagctaaggacagagggcagagaggagggatagtccaaatagggcaaaaaagggctaagagctggggcaaaatgagacaaggataggcatgctcatgacacactccctgttggagcaggactcagatatactccccaaaacacagattctttcagggaaaaaatgtgaaatccatttgtttgcatttttttttagccccagatctcctccagtggatctgagaaggtgattatgcgtggctttgacctctagttagcattttgtacaatcagggataaagctgcctaggcccactagacttccctgtctcatcactttgggtaccccagaagtagccaggcaaatggcagtcctgtgtgcctgatgactggtcatgtaatttgattgaggtataaaatatttcataacagtgatggaaaaatgtggaaaggggcccttcttggcaaaagatggagaagccctacttcagtacagtctgaagcttcatctgatgccgaactcccttcacctctgaggttcagtatctgagcacacacagggaggaagcacagtcaagactcagccgcatagtaggggaattgaggttctcacaggattcggcctgtctggcctgagaagtgctgggctataaattctggctttgctatggatggggcagcaatgccatctgccccattctgtcttttctgtaacttggggcaggcagaagaccagtccccagactcaggggacctactgggccggaaggtaggcgtctccatggtgacagctgatcttgggctggtcagtatgattcgtcagggcatcttggcactgcagttactaccctcgaactctagtgcaggtcagtagaaggaatattggtgggactggggaagcagggatacaggaagggtggggctgactgctaacaaagatagcagttccagggaatcagtgggccccagggaagaggatctgtttccttgtttgcaaaatgtaagtctgtattagtgtgtatcaggaaccctcgactctgacaaccatcagagaccctagaaggagtagagctccaaggatatcacttaggggaggttatgatctggcattcaagaggaagaagcaggagggtaagggagaaggaaaggtgtttgaagtttataaaacttcacagtttatgaaactgccgacattggtgggaagacactgagccgttcaggaccctgtcagttgggtgcctccctgtgagtttggtctggccagtgtctccaggtctgatctggtgtttcctgctccagggattatcgtgatcacggatggggtgaccagtgtacctgatgttgctgtctgtgagacactgctgaaccagcttcgcagtggcactgtggcttgttcctttgtccaggtgaggactttttaggaaggacgagagagatatggaatatctcacacaaagttgggatggctgattactttcttacaggcagtgatttcccagataaagtcaattacttagttacatggggggaaggagtcatatctagaaggtaggtagcatcgtgggagaggactcttatttttttcctctttccttaggattttggaaatagctgttaaagcaaaaagaatgcagaatttgaaatctgacagtcatttccagtcccacctccccttgtagattagtcattattgttttgagtgcaagggtcagaaaaccccgctcaaactagcttaaccaaagggggaaaaggcatagccagggactgcagctaatttggattgatggactgtagggaaggaggtaaaaagctatgggaaacaaggctgaaggggtaggcacaggccagaacatgaaaatctggttctgctttattaatgaggttaagcatgattctgtgggtgatgcagatagatagaaggaaagtcattagttgggtttatgttttataaaggtcactcttgctgctgggtgaaggacgggggaagtcggggaggctactaattgcagtgagagaggatcagggcttaaattaggggtaagaggattgagaaaaatgaagaggcagagtcaacctgacttcatgattagcaagatgggggtaaggagatgagagagaagcgggcttaaagttgtctccaagtttttgactccagtgatgactgggtagcagcagagcaaaaggaagagaagcagttgtggtagagtgaggataagatgatgaatgcaagtttgtgtatgttgtgttcgaggtgcctgtggttcaacacagacagttaagaacatcacctttggagttaggcatgctggtctaaatcctgactgcacttactaactgtgtgacattgggcacatcacttcacctctaggtcagattcatttgtaaatggagattgtaaaagtacttatctcactgggaggtgagatgcatttaaagtatgtagcattgtacgtaatcacttaagaaatggctgctatttgtagcaggtagcagttgaatacacagatcctgatattcaggagacaaacactgcttgagaggtagagatttaagatttatcagggtacagatggtaattgagaacagaagagggtcctggaagaactttggggaacaccagtgttcaaggtctttcataggaagagggcccagcaaggaatgaagaatcagccaggaaccagaagattgtgatgtcagagaaggtcagaatttttggaagaaaattttactggatctttctgctgcttctcacaatggtaactacactgtgagaagtagcaaaaagatcaagtaaaatgaggaatgaaaagtgccctttggatttggtgattaggaggtcacggggatctttttcagagccattttagtgaagaggtggtgaggggattgaagagtggatagaaggaaggaaatagggacaagtgttgacaaaagaaatttggctgttgagataaacagcagagcaagagagagaatggtaaccagagggaagtacagggtaaaggagtgttgtgttttgtttttaaagctagagacttaagcatgtttctaaggatctgtagtgaagaagagtttgaaaataaaggaaggaaaaaggaggctggtggagtaaagtccctaaattgacaggagggcattgtcttaagaaacagattgagggattcttttggagcagggaagtgtcgtttctttctttgaaaatagaaagaagtgaagatgtctgcgaagggcctccgatttctctctgaagtaaaaggtgaagctgagtactgtaaggaagaggccagagttgggaagaaggaacagtattaaggactgccctgaaggactagctgagttgggtgtcatatgttttgatgtggtgccaacctacacaactgtcagttttctctgggcaccactggccaagaatagaggctatgatcgtagttggggtttcgaagaagcagatgagagtgaagagggccagggatttgagagcgatgcttatgaagttgtctgaatgtagggtccaagctgggtcgagaaaggagggtcaggacaatgtggatagatttggagagagcagaggttcaaggcctggcagtctcagtgaggtcaaagagcagcagcaggaggagggtgggaggaagctaagggaatagtgttgtatgtaatcagtgggttatggcaatttgaaattgcaaagatgaatttgttccacatgaagccaagagccagcgtgtagcctataggcaggtgaatggaatagagta

SEQ ID NO: 455 - DNA, 8000 bp, Homo sapiens
  Locus number 67 genomic DNA region, FXYD domain-containing ion transport regulator 3 precursor, chloride conductance inducer protein Mat-8, mammary tumor 8 kDa protein, phospholemman-like
aggatcctccagcctcggccccccagagtgctgggattacaggcgtgagccatggtgcccagcctggtaattaacagatacttcgtgaccacccactatgcaccaggccctgttctataattcagatgaaaatccctgagaggagctgacgtgctagcaggggaggcagatagcaccacaaaaaaaaaaaaaaaaaagcaaacagaagtcaaaaggtcatagagaggtcagggggtaggtgcgatggtggtcggggaaagccacttgaacctcatggctttgagctgtccagatgcgggagaaaagagagccaggcaagggaataggcattgcaagggctcttggccagaaacatgcctggagtgatccaggaacggcaaggaggcccaggtggccggagcagagtgagtgacaacaggggttagggggaaccctgaacctcccctgagtttccctagtctgtaagatgggggtctccaaccggtggccccagggccttatccaaccactggatatttttcattctgtctacaaagtgttaagaaaacgaagttaccaacatttaaaaatcagggccgggtgcagtggcttgcacctataatccctgcgcttcgggaagccaaggtgggaggatcacttgagacccagagttcaagaccaggttgggcaacatagcgagacccccgtctctaaaaaaattaaaaaattagccaggtgtggtgacgtgcatttgtagtcccagctacaggggaggctgaggtgggagaatcacttaagcccaggagttggaggctgcagtgagccatgattggaccactacactccagcttgggcaacagagcaagaactcaccttaaaaaaaaaaaatccggaaggccgggctcggtggctcatgcctgtaatcccagcattttgggaggctgaggcaggcggatcacttgaggtcaggagttggaaaccagcctggccagcacggtgaaaccccgtctgtactaaatatacaaaaattagccgggcgtggtggcacacacctgtaatcccacctactcgagaggctgaggcacgagaattgcttgaacctggaaggcagaggttgcagtgagctgagatcgtgccactgcacttcagcctgggcgacaagagcaaaattccatctcaaaaaaaaaacaaaacaaaacaggagatttcatcataaaaatctccatttctagcttctgtgggtgagtgatgacgtcagagcagcacagaggcaggtgtcagggagcctgtggactcttggccactgtgtcacctcacatggctcctggaagccaggcggacagtgatacgtccacagccacaccatccccatggtggtgggacagggttacctgccagtgcccactcttctcccacaggtgctgagaccacagcgctgttccacaaagccccaggaagccacattaccctgtccaccggcctctctagccccatcttgcccaggaagtgggaccttggcgtatcgctgtgaccacacctcccagccggtcagcctggccgctcaggctctacctgcaaaggcaaggccccacccaaccagcacccctctcatggctgggggtgcctccaggctgccctctctagggccaggagcctgcagaaacgctcccagccttgaataaagagcaacgaaattattgaaacaaaatcaataaaagtttgaatcagggatggtataacatgctctggctttgattctgtgctttaattcagcgttcctgaaaaacttatgatgtcagaaactatctgtaggtttggtttttttcattttgcaagaattcccaggatatggagaaatcacagccactcacagccttaacaggttctttgggcccaaatgattccaaaagcaaaacgagagaaactttttcaaatatgtttattatgtatattatatacaatatattaataaaacatattacctacatgcatttaaaacataactgaagtcagattggcccagaagactcactccaaatgagacctaatccccaatagggtgcaagtgactgcacaaactctactcctcacagcccttcctaagactcagtgtgctcatcacactagggtctcagagtccttctgaccataaacccaagccccagcgccagcccaacacacacttggacgcagcatgttcacgtccagcctaggaagaatttatggttgacctggattgggtaaaaaccgtaaacgtctgtacctcagaatgtaagatcatggtgtttaaaactacagaacattcagaggttgtcagaagtctctaattgctggtcccccaggttgaaaccagcccttaggttgaaattttgacctgcaaatttttttttaaatctgaaccaaattttttaaattaaacccctttaaggtagtacattttcaagatgcaaaattcaaaaaatataagagggcacgtgataatgagtgagtctcacttccaccccaccctccagcctcccagtttccctctccagaagccatgggtatggatgccaatctccaaaaatattttattcattacaagtatatacatatgcattattttaccgctcacaaatggtagcacactgcacggtttcccaataccttgttttttttccccttagcaagctgtctgggaaatacttctgtatctaaccacgggcaggggtgttcctccaagatttttagacaacagttctccagttcaccccgttccggtgaagggcagagcaccccccgcccttcccagccaccctgtacacgcccctactcgctctcggatgcctgcagttcccaggcttcccagcagagggagacaccattccactcccaagaccaccaaggggtcgtcccagacacaagcttcaagggtctagggaagagacgctatccgcccagacacaaagaccccccttagctatactgagttggcctccgggcctccccttcctgtttctatctcctcctggacctgttgcttagagccctaccccgaggtccccccgcccggcttccttatgggaactggccccgccttaagagtggtaggagggagccttacccttgtctaggacctgggcttgacaacttgccccagggaaccacatagagaaggggtgtagcgctgggcgaacattgccctccccgatccctcagcgatgacaagtggggggtccttctctctgcccccagcaggccagtttccggaagagccttgacccaaacccccttttcctgtcctgtgctccacactcccagcagctgcttctccctggccaggccctgcagccctcctccccgcccccacggtggtgttggggtcgcctggagtccagctggtgtccagggcagagctacccctttcctggccctacccctccccgtgaccccaatcctccgccaaccgctcaaaggatccttgttctccatccagcccccagacaaaagtccctctgtctaagaaggcggaattgaggggagggggcacccccaactgggaccatgggggagcctgcacagaccccatccggaaggaatgcctggaggaggaggagcaggagacaggggaggaaagggggagggaggcttgtacagtgctgggggccttatgtggactaggaggcagccgcccccaccagcacccactctgtagacccaggcgtctggctcccagcacccacggaaagagcctggctaggaaactgcagcctggtgcctggcagacagttctcattctccccagggcagggagcaggttatgaccaggactaaggtcccagagtccccaccctgacccctccctgctgttccagccgctccctcatatccacccctgccccatctcctgactttggtcacgctagcatcttctgctgatcctgaaattgtaccagcggcaagatgtggcctggaaggggactttaagttctccacaactgccagcaatccttccaccaggcaaaacacatcatctaaggaaaagaagtgaggtcggaacaccaacgcatcatctcactgcatggccctggaggctctgccgtttaaagaccccagaaccttccccattcaaggtcctctcctgggcacaggagattggagaaagctcctcccttaattccaggggccgagttccagcccatccaattctccgtctcacctgaggctgctgtggtcctggtgaccccagggagcaacctgccgcccatggctggggagggggtgaagctgtctctttaagagcaggaatggagcccctgggcctcagggcatctgacttgttttctacctgcccaggtttgcttagggcgtggcagcttcggataaacgcaggactccgcctggcagcccgatttctcccggaacctctgctcagcctggtgaaccacacaggtgagcagctggggccccttcctccaagccctccttgtctctgcccctaaattaggaagtatctacctgccccctgaccctgccccatagaagcttttatgttaaagcgcctaaaatcttgtgaaatgcttttctggagccaggagataaacggaagtcccttcccctaatgtccctttccccaccattctcctctcagggacttgttgaaccagctgaggtgagggcaggactgataagtgtggttggggtgtctgaaagactagtgtctgcatggattagggatatctgggttggggatagctgggtggaggagagggggtgcctgggtaggtaggggtatctaagtggaccaggggtgcgtagatggactggggacatctgggtggatgaggaatgctgggtggactcggggtgtccagacattgagggatctgggtggataaggagtgctgggtggactcggggtgtccagacattgagggatctggattctggagacctccaggaaaaaaggatggagctgctgggggaagctttaaatggggagttgcttgggagatttcaggagcacacagcgggcaggatctttctacccacccctgaacatgagaccattctcccatggtatggaggaatagaggggatagcagagggcaggtgggggaaacagtcctcaggccggccttgggacctcatggccaggaaggatgagagcaggtagacagagcatcagctgcagggctgccttcctctctaacctgctcaccaaccacatcagttcgggagcagcccacagcctcttcagacaacagcctgaatggggaacgtgagggcagacccagctcccggctccctgcagcctccggaagcatgggactggacgttgttttgcagaggctggggcgaggaggataccatctgtcagtcttggctggatgacatcatgggaagggggtatagtggggccttgcaggccagaggtggcttggaggagcccctggaaagaggcttaagaggtgagactcaacagccatggcgacagagcatagggctttaagatgaatttgcaggggttacaggattacaactgcaatgtgggctaataatagtgccccctgcattaagctgcagagattgagcgagtaagtgggaagctgagaaaatgcccccatggggtagacactcaataagcatctgctgttattaccaggactcgtatggtcatgggtgacagcttcagaccacaggcagtccacctacaacctgtgcccctatccaacatgccatcctgcccacccacccacgccagctcccccaacccccaacacttttggggatcctaaacacttcctgggcctcagtaatgctccccaaagcctcaggctttcttcccgcaaaaaaaggaaaagaaatggatgctccaactaaaattgtgagttcagcatgtggaattaactgggaagctgagaggattcccaggccctggggtgccaggcagagggaggagtctgtgccaacctgcaaggaccacccgcaccgttggttgcgggcaccaccctctctcagcatttttgctgttcgtgaaatgaggacatagtggacgacgtcggggattgctggggggttaagtgagtgagaacacggcaaggtcagtgtgcactccagggcaaggtggaggaagtgccagctctcgctatcaaaattataactaggccaggcgtggtggctcacacctgtaatcccagcactgagggaggccggggtgggtggatcacctgaggtcaggagttggagaccagcctggccaacacagtgaaaccctggctctaccaaaaatgcaaaaattagccgagactggtggcacacgcctgtagtctcagctactcaggaggctgaggcaggagaatcacttgaacccaggaggcagaggttgcagtgagctgagattatgccattgcactccagcctgggtgacagagtgaaactccgcctcaaaaaaaaaaaaaaaaaaaacaattatgataactatgcactcagcatttgggcagggacagggcagggacagggcaggggagggcatgctcggaggccagggcttggtgcagccttgcaggctggtgagagggcaggactgatgccaggtcaggaaggagagagaaacgagttccttatgctgagcaggtctacctgggaaagagaaagtgtttgctgtcaccaggaactctgctgggcctagggtagggtcaggggctgggctggggaccccggctaggcagagccagggctgggaccgggaagggcatgggtgtgggatgaggggcaggaggttcgggggaacagagatggagctagggctgcagccaggaggtagagtccccctctacccccagtcccagcctcacgtcaattcctccacacaccaccccacccccaagcagcttgaagaacctgctcagtcctcagcctgaagtctgcaatgtcctggcagggccgggcaggctctgagcggtctacggagacactcctgggaagcgggcctcctgccgcctggctcccaatgccccgcttccccaaacaccccaaggccctgacagtccctagttaggagcagctgctggggagccaggcctggcttaaatcctacttcctggctagagcacctagtttcacctctcagagcctcagtctccccatctgtccagtgaggacaacagcgggcagtggcgcccttgtttggttgcggggcgattcccagaaagcctgaagtccatgtccagtgagttattatggctcctcccgcctcaggcccgagtttcacccagtccccactccacggtgcagctgcggcttatctctcagcccagcgagatgccagccttcctgtcccgggtgagctgcgcaccctgcctggggagcaggggaggagggttggggagccacaggcacagggccagcctcccggtggctctgctaaggccagacctcccgccacccctctaggccagcgctctgacatgcagaaggtgaccctgggcctgcttgtgttcctggcaggtgagtacccatcccccgtctgccttttcctctggatcccctggatgcggggatccaacctctgtctctctcctgtgcttttctacctccccgggaaggtggtaaatgttagaacagcatctccctgagggtaagaaaagtcagactagtgatagccggggatacacgagaagagctggctcacacagctggaaagtcaccgtcttccccattctctcgatctcttctttttttttggctttttttgtttttgtttttgtttttgtttttgtttttgaaagggagtctctgttgctcaggctggagtgcaatggcgcaatcacagttcactacagccttgaactcctggggtcaagcgatcctactctcttagcctcctacacagctagaatgccaggcacacgccaccatgcccagtgcatttttgattttttgcagagacgaggtctcactgtgttgcccaagctggtctcaaactcctggctgagtttgatcctcccacctcagccttccaaagtgctgggattacaggc

SEQ ID NO: 456 - DNA, 8000 bp, Homo sapiens
  Locus number 68 genomic DNA region, homeobox protein Hox-A2
taacaagggaggggggaaaagcaacaacccagtgacacaccctagatcacattttattgatatttcatttaaagtgcttttctctctctctagaacctgcgttaatttataacctagggtgtagaaacacaccattttaaatctcaacttgctaacctgacttcgaagcattaacgatctattattagcaatgtaaacaggtttaagaatgaaatattgatttttctgaccctgaaaaaaaaaaaaaaatcctagagtgactgaaccagaggattggaaagaacattttctagggtgcattttccagatagtaatcactgttttgttttatttttgtttttctctatcttttaggtctgttttgcctgaacccatcaacagctgggagattaatcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatcctttaaaaagaaagaggagaagaagaagcaaaaaagaaagaaaaaacacttattagaagccctagtcattttttggctttctgttttgttgctgtccattgaagactttgaacatgccgccttaataaatgtattaaaattgaaaaaagaggataaattgtgacgaattttatttacgaagttagactaaaagaagaaaaagaacccgttatgagccttgaaaaaagagggggagaaaaataagctacttatagcaaaggagaatttattctacaaaaaatatgcatgacaatgcatcccaatgtaatacaaaaataaaaagaaagtgaagatacaattatatgatcactttcttgcaggcctcatactgctctcaggaatcacataaagggttgttgagttaggtttaaaacaactaaaactccaaaataatctgtaaaagatggctctgtttgaaactgggtcagggaatcactaaacagaaaatcctcaacacttaaaggagggaaggggtaggtcaagaagaaaataaaaaataaactcccaaataaaagaaggcaaaaccacctggtcaaaggagtttttgtttggtgatgctttgttttgctttaatgtttttagtaattcagatgctgcaagtcgattgtggtgagtgtgtctgtaaaaaagtctaagctgtcagctgaaatatctacgggactgtcgagggaacctggcaaactgggtgaaactgcatctgaaagctgcaggcaggaatctgtggagaaaacgctaaagtcctgcaaagaggggacctcaagggcctcaggactgtcattgtttaggccagctccacagttctggcccattgttgacaagcagttgggaacagtgggtgactggtgctgaaaatgtttcagatttttctcattgctggttaaaggcgagactgggaaactttgggagtcgccattgtgtccattgggagcctgctgctgagagagggcattttgctgaaaagtgtagccttccctctccagaagggccccagagacgctaagggcttgctcaaagagcgtcttctcttcctcgtcctcctctactttctcggagtcctcaaggcttttacatttcccttcgctgttttggttttccttgcactgggtctgcctcttgtgcttcatcctccggttctgaaaccacactttcacttgtctctcagtcaaatccagcagcgctgcaatctccacccttcggggtctgcaaaggtacttgttgaaatgaaattctttttccagctctagaagctgtgtgttggtgtaagcagttctcaggcgccgcgatcccccgccgctgccatcggcgatttccagggattctgcggaaagggaaaccaacaagagacacacgcacagttggaggtggaggggtccgagcggggttattccactggagaataaatatagcagaaaagatcaactgcaacaaaatggccgcccctggatgcagtagagctattgtgctgcctttcctgggagcccagcctgggcagaccccgtcccctccatctctatcgaattcatgcctgtggctccccccaacctcttcatccgggagcaaactttatattagccacaacacaatttataattaatgcgtcagctgcttagctgagcaagagcgatctatcactcttcattactgtcaaaaagccaaactctaggacaactagacaggaggaggtcagttccaactcaaataaatcatcccacattacacaagttcgggaaagtttccccccacttcctaaaaatatatatgtctcattgtagagcgcaggatcccctttcctctccatcaaacccactcctgaacccacaggggcagggacaaggcaaccaagcatctctccctctcctccttctctcccagcccactctcccctccccccacagccactctcggggcagcccggagaaggaagagggtcccagagacctggggccaagtctttggactgacctttgtggctgaggcaagcagggccggtggctgcggcggtggcggcggcggcggcggccggcagaagtgcggttttcttggccgccttcttctccttcatccaggggtactcgggcggctgcagggcgccggcgggcaccgggctgccgcggctgcccgcggggctcggcttggggcggccgccagcgccgtggcgagggtgactgccggggttcaggctgggaatggtctgctcaaaaggaggaggaatcagtgtcgagtgtgaaagcgtcgaggtcttgattgatgaactttgaaatgtatcagcgacagggggaaaagatgtcaggcactcagcgagcgacggctggctattgataaaaccaatctctcgctcaaattcgtaattcatggccttctccttggagccccctcagagaaaaagttccctcttttggaggggctttgggggggcaaggcctaggaaaaaggcgagcgcagaggaaaaaaaatctatcatagaatatcgctgctagggtgttttttttctaattcactgattacagccgtatggggaccgcgctactattaaactattgaattcatggagacaaggttgaaattggaccgaattggctgtcacatgattgcttctgcccaatgacaatttgggctttaatcaaaagaagccactgtctgtttgattgatccaaaaaagtcgggaaggaacgcctcattgggggccagcgaggctttatttacacttttttcagagcaaaaatacatatatgttggtgtgggtggggatgtcccggagtacgtgggggcgagggtgcctgcgtgcctcctgatctgcaaggatctatctagtgtgtgtgcctgggagtgtgtgtgtgtgtgtgtgaatgtgcgcgagtgtaagccctgctgtcggtcccgccggtggctgccctctgcctcccccgcacactccgcgcattgtttgggactgtcgggaagacgcctcgcacctcacaaatcatttaagcacctcagtctgacgcctgcagtcattaacaaagtaatccattaatcttcaaagttttgacacccgagggccctgcgtcccagccacataagttctgttaaagcaggagaaaggagcagaggaagagaggagatgagagagggagaataaagagagagggaagaagagagagtttgagagatggagaaagagaagacagaaaagagagaagaaaggaaagattttggttgggaaggggtcttccttttctttcccttttcctccttcacttttcctaaaagcagttcctggatctcaaaactgatctctctcggtctgttttccttcctgtctgtccctttccctctttttcctcttctccccctttctccctccctctctcttctgtccgcctccccttctcccctcagcctctcgcccccctcccagtgtccagcccagagtctgcgccccgggcccattgttagcaggctattccacggcagctttgcatctggctccggcgggaagcggaaaacgggaggcggctctcgaagcttcccgaccttcctgcgccatcaacttctcaggagtggctggagaaagatgcatgtgccaagcgagacaacaaccccaggtccatgtgtccaaatccccgtagccagggcggcggccagccaaagaaatgccgccccgagcaggcgcgtgcggctcctggcattctgggtttcatacccgtagggctcgggtgcggtgagtatttccgatttccaggaagtctgttggaagttaccagcagggaaagagaagatgcttgctcctctctttccctccctctctcttttttttctacccttcttcttgtccttgtcgctctggttgggggctggttggtttagatacagcgagtgctccctggcagcctgaactgcctcccacaccttcctgatccttgggcaccggggatgtttgcttccgggttctgttgtgggaaacagcactgcgggggagaggaggcgacccaaggaggaattataaaggttttcgttctccttcattatcttttttccaattcggagacttgagactgagcgcatcttggacagtgctagagggttcaaaagataacacctttaggtaccaaaaaataatttttaaaaaatccaccaagccagaaagaggtgaggaggctgagaggtagatctggaggtacctctttcccccccaaaccctgaggatggtgattcgcttttgcttcctttgaaatagactaactgatcagactcccccaggccggcaggcatcaatggcaggaaaataaatcattctgatggtcagggagagagaggttggagggggagaaaaatctacgtagaaaacaagaaaggccaaccaaggagcaaaggcaggaccccatctctgaggccagcgtcaaagagggtttggggtggaaattagacataagtggcctatatcattgaccagcccagagcattgccttgcagatagagatgctattttggaaaatgtgaggttttttagttttcttgcttttattccaaacaaagctccaaaggaagtctgggcgcgatcaatcttgctcaccaaaagccttgacagcttctagcccttaagaacacatttcagcttccagctccttccaagataaaatgtggccgagcaaagaggagagcaggaaatgcaagtaaataaggaaaactagtcttttaaaaaatatattttggcagtgaaaagggttatagggctccttttaggaagggtgctttgcgaaccctgggatggcagcttttggcatctgcttttaccagaaaatattacaggcttaagggaacgtgggcggggggtgcagagagggagcagcgctgcccccatatctctgaggctttgtcaggggctgcgtgggtgagagctttctgctgcctcagccgccttaattcaaataccatctggaagaaaacccttttctttgaccactcaacactgaaatcttccccaaatctattactttaacttatgagatattttaataaggatttctttttaatatctaggaaactggggggtgaagtcaatacttttttctttgaaagccaaaatgaatgtcttgactggtaagatgcgggaaatcacattagaatctcattttaaaatcttagccctgggggaaggaggaagcctccaaaccacccctccctcagctaaagagtagatttcagaaacgtgttcaaatagtgatatccctgaaggatcttcatccttaggtgaatctctcccctagctgttccttatttttccaggtaattttacacgtgtctctaagctgattacttaaaagaagactcctgtatctgcttagcgtgacgaagaggtggaagctctagtcttcacaaagcctggttttgcagcctctgcatttctgaggtgcgccatattttggcgcagaggttgaggtgcggagaggaaatctatttctcccatagcccaaaccctttaaaaaggatatatatatcagcagccttaggacagatatggggaaagcacctctgggtgtgagagaaacactgagctctccacagcagcctggcttggcatcctccgagccttttccttaaaccatgaggagtttctctaaaagcagctcgttgggacccagcaggtacccagaaatggctccagtgcctgcttctaaggataatctgagggagcttcacagggggaagataaaggccatgatgatggatattttggattgcaaacaaaatggcgacattttccacttctgtctctgaaagatacaatccagggagaatagggatttatttctcacatccgatgctcctgatccccagacgaaagcagttcctcgcttctagctctgaagggggtgatgatggggatgcaggtctgaggtctgcattttctgaatttgattcctttctcgaggaatccttaaatctgaagatgaaaatatttccctttactgtgccttcttttgcctcttctagccagtcagtaagcagccctatcttaaatccaggagtggaaatgtaatatttagctcctacaacatcaaatgaaaaatttataaaattgcagttttattacaaagataccgatctccttgctctctccccctccccctggggccataaaaagaaagctgggtgggggaaggagaggaaataaattcagagaatgccaaatactacattcagcaggaagctaatgctgggattccggcagtccagggaagggctggctcagggtgactctccccagttcagtcctccgtttgctggagacctgggtgagcctcagtccctttcaaactgtttcgctccgcgtgcagatttttggagcaattctttcctcctgacgcgataacagaccgcgaagcatccccggaggagaccaggagtccgattgctcccggaaagtgctcggcatcctctgcgcggctggctaataccgaggtttaggcgttagttggtccgctttgacccgaggaagagcatggagcagaagaccgccctgcgttatcccccggctgggccgcggggcacctgtgcgctcccgctgcgccttgggccgggatgtctttgtttcttccgtgcacagcactcggcagcccctgcgccctcagcctgcctccgcagcagctgggaaccgggcagcccagctggcccgccgcacggcgttaccagagctgccgcagccgcctggagccccagccgccatcctgagaattcgccgagcttccaggcgaatagcctggccaggccccatgctggagccagagggctgctgcgtccggcctgctctgccggctcgcctcggcctgaattccacgcagacccacgtcttcggccaaagaaccccttcttaacacggatattattcagaataaaaactttatttctttttgtttctcagaatgtgagcagcaaggaatgaagaactctcaaaacaaatctagtatttttcgcgtttacagattttttttttcagttttgccggatgttacaaacctaaatcactgttttcaaaagctggatcttctctggttttattgtatcgttaccgtttaaaggaattatatttctctttcaaataaaaaaaattctaagtacgccaatacacaattgaacaaaaggcccaagaacccttctgaaccatcagggtacagaattctttaatataaatacgaacggatggggataaataatatttaaaacttagattattcaatgcttgcaaaaaaatataaataaatctgactgttcaccagcatacacacacggaaagacgt

SEQ ID NO: 457 - DNA, 8000 bp, Homo sapiens
  Locus number 69 genomic DNA region, potassium channel subfamily K member 6, inward rectifying potassium channel protein TWIK-2, TWIK-originated similarity sequence
gggtaacttttcatgatcagaattatcctcttccatgccgggtgcggtggctcacgcctgtaatcccagcactttgggaggcctaggcgggcggatcacctgaggtcgggagtttgagaccagcttgaccaacatggagaaaccccgtctataccaccccgggcgtggtggcctgcgcctgtaatcccagctacttgggaggctgaggcaggagaatcgcttgaacccgggaggcggaggttgcggtgacctgagatcgcgccattgcactccagccttggcaacaagaacaaaactaggtctcaaaaaaaaaaaaaaaagaaaaagaagtatcctcttccaggaagcttcactgacacccctaggctgggtcatgtgcctcctcagggctcccacaacatctccatcccaacacagggcctgacacatgggagttgagacaagttaggttgaatgaataaatgaaacacacagcacactcacggagatgaagagacaggaaaagggggccaacagcacaatacaggttcgcttcttaaatgagcggtaggcatggccctctgcgctcccggggggccacgaagctgtcctaagggtgtgggcgacagcaggcgggtactggggagccacggaagggtggggagcagggaagggcggatcgctaactgcaaatgaatgaaagttgcatttctctgcatatcgcacgctatccagtcccaagttgttttcttctaaaggaatttcctaaagaatcgccccccaaggggcctcctacccgaacctggcatcccagcgctgtgcacacctcagggttccagatccttgatctcgtgacctctgacctgcagtgacctcgccaaccgacgcggccgccccgccacgcccccgcccgcccgatctcctccgccggccacgtacgccacttacgcagccggggcgtccccgcagccgccgccgccaagcctgccgggtgcatccttcgccgccgccacctaagccgcggttcggagcgtgcccgcccggctcccgtacccacgccccgccggcgaagagacagccaatggacgtcaggattgagggaaggcctcgcccccacccccccgacccctccagccccccccttcacggaggcctggacgactgggcggtgccttacgtaagaggcggagactgggctactgggctcatgcagtaaagcgagtcaaggcctgagtggcaggagggcgaggccgggaccaatcccaggaggaggcggtgtctgccacgacagaaaatgagtgtctgccccttgccggggctcacgcccctaactccagcactttgggaggccgaggcgggaggattgcttcagcccagggattcgagactagcctgagcaacatagtgaccctcgccccgccccatccctacaattttttttttttttaatttagccaggctcagtggcttaacgcctgtaatctcagcactttggaaggctgaggatcgcttgagcccaggagttcgagaccagcctgggcaacagcgagatctccatcgctacaaaacattttttaaaatgtaaatatcgagcgaaaaggtcgatgggaaatgcagttctctgcagacagccgttcagtttgggtcattgagagcactggagagccagaaaaggctgtggagcaaggaaaagagaaacatttgtgttcctgaggggctaattggagttgtaggggcttatacaatttttgacatcccttaggtattaaagtaaatatttatttattttgagacagggtcttcctctgttttccaggctgcctcggaccccctgagctcaagtgatcctcctgcctcagcctccccagtaactggcaccacaggcatgcaccaccatgcccagctaatttttaaattttttgtcaaaacaggatcttgctatgttgcccaggctggtctcgaattcctgggctcaagccatcctcctgcttcagcctcctaaagcattaggattacagacatgagccacagtgcccggccttaaagtgaatatttagagtgagaaaaggaaacccaacaagttaggtgagaagaaccaggtgtctctcttggaatagatcttaaggcagtttcccagaaattcataaaaatgttctcacattgcaacctggttccctctgtccaccaaaagcattctacaacccccagcaactcacagcacacaggcgcacctgcaagtgaagagccctgcccacctagcgtccttagtctctcctctctctgactctcagtctccccccttctctccctctcagactccccgacttatctcaggaaaacatagtggtggaagttacttctgcgcagcgatagcgcatccggaaggatgtcagcaagtgaccctatcgctgtggcttcctcttcctcctctgagacgttgtctttttggagaccttaagggctgctcctggtttctcagtgatgagtgctggctccactgtggttcctttttgtgagcgaaatgcccgcattcttcttcacctctgatttagcctctgtcccctgggctccaacaccattttctcctcatcctcagccctctcttgctctggttgctccagatacatctcttccataaatgtttttttttttcttattgcttttttgtttgttttttgagatggagtcttgctctgtcgcccaggctggagtgcagtgatgcgatctcggctcactgcaacctttgcctcctgggttcaagtgattctcctgcttcagcctcccgatagctgagattacaggcgtgtgccatcgcacctggctaattttttgtatttttagtagagacagggtttcgccatgttggccaggctggtctcgaactcctgacctcaggtgatccacctgccttggcctcccaaagcactgagattacaggcatgaaacaccgcacccagccttatgtatatatatttaattaataaagcaagtactgccaagtgcagcggatcacgcctgtaatcccagcactttgggaggccaaggcgggcagatcacctgaggtcagtttgagaccatccttgccaacatggcgaaaccctgtctctacttaaaatacaaaaattagctgggtgttgtggcgggcatctataattccagctacttaggaggctgaggcaggagaattgcttgaacccaggaggcagaggttgcagcgagccgagattgtgccattgcactccagcctgggagacagagcgagactcttgtctcaaaaaaaaaaaaaaaaaaaaaaaaaaagcaagttcattagttcattggcttcctgctggcctcatgttcaccccttaccagttgtgtgactactactttttatttttttgaggcagggtctactctatcacccatactggagtgcagtggtgcgaccataactcattgcagtctctaattcctgagctcaaacgatcctcctgcctcagcctcccgagtagctgggactacagacgcatgccaccacacttggctaatttttgtattttttgtcgagatggggttttgccatgttgcccgagctggtctcaaatgactacttcatttttaagcctaaattttctcatctgtttagtgggaattatattgggacggggttgagaattcagtgcaagttcaggtgtccacagggcctggcagaatgtaagccttcgatcactggcacctattgtgttactgattctattatcaggtgcctctgcttctggattgtcaaccccaagttgggctctgcccggtgatctgccagctctttaatagaaccagctgggacatgtctgagctgagccccaagccccactcctctgccagtcggatggggttaggactctgggctgccctccaaaaggctgtcaggaaggcgctgagttctggctggaggcagaagtggagagacttacgggggggcgcagaaagaaaaatttcctcttaaatagaggcgtgtatttgtgattctgcctggcttgtttccattcatccttcatgcttcagctcagctagccccttcctcaggaagctctcttgacctccctaggcaggggtggttgcttcctctggactcccagggccctctagggctccctgattccaggcttgatcattgtacccttgcttccctcatcacagccctgaccactctgggctgtcttttttcttttttttagagatagggtctcactctctcccaggcatagctcactgcagcctcgaactcctgggctcaagcaatcctccgacctcagcctcccgagtagctgggacaacaggcgtgggtcactcttgtgtcagtctcccagttagactgggagccccatgaatgcatggcgcaggatggtctcatcattactgagtctccaggatcatccagcgaggggtcagcagaaagtgggcattgaacaaagctttggtgagtagctgaggatccccactctgtccacacgggcacaggggacacctgactctgtggtgtccgctgttcccactccgaggctcacaacttggcgaatggagcgagaattggatttcagtttgccccttgctccgtcagccgcgcgccctgatgcagtgcacaaccttagctgctgtgcgcgatggggggcgactcctcggcctgcgagcagagaggaaagttcagattcttctaacatagagaaccagccttccaggaggacgagaaggaaggaatgaggggaagagaggactacctccaccctttccatcccgttggtctgctgggtctgggagcactgggctccaccctctccgaacgaacacctggcggttgggcgtgcctcagtttcccggaggcggggcattcctccgtcgccgccccccacctcccctttttcctcttcctcttggggcatctgctgccgcgcctgtagcactcccggaactggaactaggtgccagacggtccggaggcgggggccacgtcagcggggccacccagggctcgcggggtcccggtgggtgccatgcggaggggcgcgcttctggcgggcgccttggccgcgtacgccgcgtacctggtgctgggcgcgctgttggtggcgcggctggaggggccgcacgaagccaggctccgagccgagctggagacgctgcgggcgcagctgcttcagcgcagcccgtgtgtggctgcccccgccctggacgccttcgtggagcgagtgctggcggccggacggctggggcgggtcgtgcttgctaacgcttcggggtccgccaacgcctcggaccccgcctgggacttcgcctctgctctcttcttcgccagcacgctgatcaccaccgtgggtacgtaagcgcctcaccgcaaggcggcgaggacccgggatccccacttcatccttaacccctggggaccccggggccctcacgaatacccttatcccaatcccctctgggcttcggatcccccgaaaagaccccagtgaggacccgggacccaggctcatgatatctgctctgctcggggagcccaagtccgagcccttcctcctaagtaggaaacacccagctcccctcagagtacctttgcagagaccagctgggaccccgttcctcggtcttttttttttttcttttctttttctttttttgagacagggcttactctgtcgcccaggctggagtgcagtggcacgatctcggatcacggcagcctccgcctcccggtttcaagctattctcctgcttcagcctgccgagtagctgggattacaggcacataccaccatgcctggctaatttttgtattttcagtggagacggagtttcaccatgttggccaggctggtcccaaactcctgacttcaggtgatcagcccgcctcgccctcccaaattgctggcattacaggcttgagccactgcactgggactgcattccccggtcttaatcctcttggtgacccgggtctgtccagccccctctaagcctaggactgtcctcagagacctccagcaaggacccaggacacgccaccctccaagggagatccttgccccctctggacccagaactcaaccatgccaggacccctgactttatctctagtctgggcctgccacccttgccatgtctcctgaccctccagatatgtccttctgggaaacccccctggagaaaccccatctcaacctcctcctgaccctggcgccttagcgaggaccctaaatctccagacctctcagggtgtcctcactaaagacctccctcccaacagagattcctcagcaaggacctggcaccgccatctgggactcctggccctctggacctgggcctctgctccagactgtcatctgtctcctggccccatactccccagcaggcaactctgaccccagacacaaaacccttccctaggtaccccaccccatcttgacatctcccctatatggggtcactctcaatgcaggattttcctcccaatagggacaccacctgttccctctggacctgggactcccaattcagcagccccagctagggatgtgtcaaaaggacccaccgtggagggaccccgagttttgggaaaccctgagaagccagacttgggaaatctctttgttgccaggctctgctgctcccccagccccttctcagctcccagacttcctctttgtttctttgttggggatttgttgaggagaggaggctggtgcagggttagcccagactcctaactcgccctcccggccaacaatagggggcagcttttgcttttggtcccctggcagcagagctgggtgacttctcgttagctgacctcccctgggtctgcccatgctgccagggcggcctgacctgcttctgagcttccctgggtcatgtgcacgcctcctacctcttcccagatcctggcttctaagaagtcatccctggcagggcagatgagggaagccagacacacgtcaggcacagcctggctacatccctgctcagccgcggctcattgccaggcctcagtgtcctcccccattgctaaaatggagataataacactccccatttccctgtaatagcagtagcctgacagaggacttgccaatgcatgctttaactcacttaatcatcacaacagccttgtgaggcaggcgcctttataggctgtatatttttagccatggaaaccgaagcctagagaagttgggtaactttcctaaggtcacacagcaaagacggcatagagtagagatttagtcaaggccatcaggctctagagtcccatgctgctagccaacacaccacactacttagaagaagggtgctgtgtgtgttgtaaaagaaaaaaatatgctaacacttgttaaaaatggaaagttattgtggtagaggagagaccattgcaaaggccagagagactgaactcaactgtgaatatagcaaacacagctggagttttatggctaacaagtagaataagggagtcagtggatggaagaatactaagaggagagacattcgggtagggggattcttgctaaactcagcttaacaagattcttgctaaagacaggccaaggacttagatattgagagggggtggatgagggccaggcgcagtggcttacgcctataatcccagcactttggagggccgaggtgggcagatcacctgaggttaggagttcgagaccagcctgaccaacatggtgaaaccccgtctactaaaaatacaaaaatcaaccgagcattgtggcaggcacctgtaattccagctactcgggaggctgaggcaggagaatcacttgaacctgggaggcagaggttgcaataagctgagattgtgccactgcactccagccagggcaacagagtgagactccatctcaaaaaaacaaaaaacaggccgggcaagttggctcacgcctggaatcccagcactttgggaggctgaggcgggcggatcacctgaggttaggagttcgagaccagcctggccaacatgacgaaacccc

SEQ ID NO: 458 - DNA, 8000 bp, Homo sapiens
  Locus number 70 genomic DNA region, zinc finger protein 264
ttgaacccaggagatggaggttgcagtgagccaagattgcaacactacacaccagcccgggtgacagtgccgagactctgtctcaaaaaaaaaaattattgtggaggaatggtctcactatgctgcacaggctagtctcttaactcccggcctcaagagccgggtctgtcctgtagaccctggctgagcgatggatgaaaggagtactcagacacaggtatgtagtgtaagagcagctaggggactgctgaagagtgagcagtcttgataagctgggactgcttgcttttattcagtacagacataatgccaaaagcctggagccaacacagtctgtgggtaattaacattattgttcccccttttgggggcagcctcactcgtgaatgatcaaatgttggttcctagttaacataagtaaacaagcctgtttatgttaaattcccctacacttccttgtacctactccttgccctctgccttagggtaagagaacagctgctttcagcttattctcccgtgaagctatgcagagacttctgacctttcagaaggtttgcgtccttttcttatagcttctcccaccactctgaccgatctcctacactcaagcaatcctccttcctcagcctcccaaagtgctgggattacaggcatgagccaccgcacaccacccccatttcttgcagtaaaatatgtgtgtgtgtgtgcgcgtgtgcgcgcgtgtgtattccatttctccctaataccatttctcagctgcatgaatccttaactcatgaaagatactttttatcctcttgactctacagttaatggaaaataaaaatcatcaatagtgacttctaagattgcttaatatacctttctgggaggacagttagaactcctaatgtgagcttgtcagtttcttgtgaaaaccaacccagttgtcccatagaactgatgtttgtggtttcttttgactgaacctagaaattgaccctcccactcttaaaacttgagaaaagtacatttgtcataatcgtttgtcacagaaataaccaaatttccttgtccattgttttttaactatggttgtcctaagacttttgtcatccacaattattgtttgactttgagtcttctccaaaggtggcttacagtcagctacagttcagggcttctttgagagagttcataaaaagaacacttgaattcaagtttctggtaactttggagattgtcctatcagcctagagagaaaacttccaggactctaattagaaggctgatatattcataaaatacataattatgtatacatatgtttatgcaatatgaagcagagcaggagtttcatggactgtactaatttatttcatgataaataaaaatattttattatatagtatattaagccatcttagaagtcactgttgatgatttttttttctccattaactgtggagccaagagggtaaaaagtatctttcatgagttaaggattcatgcagttgagaaatggaattagggagaaatggaacacacacacacaaacacagagatttatttcaagtactgaatttattttattattttttgtgtgtgtttgaaacattgctgattctttttgttttgtttttgagtcaggagaactttttttgtaaatctactttctgtctctatgaaacttttttctttccagctatttatagcctttaacaattgaatatacatttgtaaacaaaatttgagggctatttctctctctgcctgatttctccagaattcagaaactatttgtgaatattcttaattcacggcaatgtggttgtttgcatatgttcaataagaatctgttttctagctaggtgtagcatatgttcaataagaatctgttttctagctacttgggaggctgaggcaggaggatcgcttgagcccaggagtttgaggctgtagtgagctatgatcgtgccactacactccagtctgggtaaacaagcaagaccctatctctattttttaaaatccatattattttataacacaattgtaggcactgggtcttttcccaaggctttgacaggaatggcatatttttaactatgcgagactgctttgaggaattaagactgactttatgggccaggcgtggtggatcatgactgtaatcccagcactttgggaggccaaggcgggtggatcacgaggtcaggagatcgagaccatcctggctaacatggtgaaaccccatctctactaaaaatataaaaaattagccgggtgtggtggcaggcgcctgtagtcccagctactcaggaggctgaggcaggagaatggcgcgaacccagaaggcagagcttgcagtgagctgacatcacgccactgcactccagcctgggcggcagagcaagactgtgtctcaaaaaaaaaaaaaaaaaaaaaaaaaaagactgactttatggagctgatgggagcccttggaaggactggcctcatatcttgtgcacacagttcctttgtggggttcctggcctgtagtaaatacagtgtcattttctgataggcctaggaacctcaagatgttctggggcctcaagaaaaacgggtttcacccaattcatgcaggtatgtacaggtgcagacagatctttggctgggcttaagaggtctttgggtgttgagtctgagagattccttatgaggggttccagcaaagccaatttaggaggaattgtataaacagtgattcttgctgtagtttggataagtatggtgggactgaagcttgttttgcaggtaagttgttcctgctgtgatttgcttttgatggaagtcagggactagagagagaaaaactgtttccaaagaaaactatagtgctgccaggtgcagtggctcaactttgggaggctgaggtgggcggatcatgaggtcaggagtttgagaccagcctggccaacatggtgaaaccccgtctctactaaaaatacaaaaattagccaggcatggtggtgggcacctgtaatcccagctactcgggaagctgaggcaggaggatcgcttgaacctaggaggcagaggttgcagtgagcggagatcgtgccactgcactccagcctaggtgaaagaacaaaactctgtctcaaaaaaaaaaaagaaagaaagaaagaaaactatagcgttagattaacctttgagttaatctgagtggccacgtggtcatctatggtatgcagccacccacaatacccctcctcagcataaagcagccagaaagatcacgtccagattccccatgattgaggaattgataaatagaaacagggaactgaaaccagctccagtgtcccatagaactgatatttatggtttcttttgaatcaacacattatagacattgagcctccccttcctaaaactcgagacacttttatttgtcttatctgatttcctttctcaggaaaccaagcatcaggcctcccagatagtataaagaaactgaaacttactggattaccacatctggaaaaacgagatgctataccccttacccatgatgattgcctaactgaccatctgctgcctgttgacccattcctcttccttaccccttcctaattcctgttttctcaaacatagttacacttcttccctgatgtataaacccctagttttagtcagttgaggaaagagatttgagattgatctcccattttcctcagctgcagcaccgaataaagccttcatccctgacaatactcattgtcttgctgactggccttctgtgcagcaagcagcaggatctagatgcaaggacctggcctttctggtaatattgtcatcaaccatttaatgatgtagacttggtccccggctcatgctctgtgtattttcttctccatctacatgcattgccttgatggtctcactcaatatcatgacttgaaataacagtgtaaggtaactcctaaattcatatattcatgctcaaaccttcttccaacattcagtcgtaagtcgaattgcctgtgacagagatactttgtggttctgtagacatttcaaactaaccatcctgagcctccgaacctcctccacttgcagcctccccacctcagaagtgggcaaatccactttttgtgtggtctgggccaaatacatgactccctgcatcacgtagaggctgtgctggtccaaagaaggctcaaaagagggcagtttgcgcacacaacgtgtcggggcagggcttccagatgatcattcggcttttttgtgtcttccaagatgatgatccggggaggagggatgtgaaagggggtcagtcgccaggcgagctgaggacccagttctgcgcctttgcctgtgccctgacctgaaggaaagtccctgtctcccgagctccgattttcccgagagaagaatgcaatgtaacccttgcccctcggttccctccctccatccttcccctcgagttgtgcccaccgtaaagaggtgggtctggagcgtctcctcgggtcctggagtgcctttccctgggaggaaaacttgcgccgtgaagcgttcctcccgttgttgaacacatgaggaaaactacactacttagaaggctgtgcattatgcgtacggcgggagctgggccaacgacggcctaggacggggacgtttccgacggctcacgccggtgggggcgggacttccgggttgctcgctgcggacgccattttcttctgcacttctgtctggagaggtctgtagccactgagggccccggtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgagtggacggtggcttcgcggttgccgcttccttgccagcgctgaggcggtttccgaagtgggtgggagcccaggtatcccctggatttgtcttcgcagtcgtcgttcgctttggtgtgtggagctggtttgccacttaatttatacctggccgtaaggagtgttgggcctactggaaggagctccgtaggttgttgagtgaatgatgcttcctctggggactcccatcatccttggcctgcaagcattctctggtggaccaggtctcattccagcatgaattgggggcctgaggggggaaggggagggcagggcagtagcaagccgacaaatgcgcgagcagagacaaggtatgttgtatgtttaaggaggctcaggagggtgtgtaaggttgccatggttttcctgcggccgctgagacgtggagggcaacagtgtgtggtcttttcctggatgttctagccatccgcaactactgcagacattgtggccagtcagatgcccttactctcatcgctacagcctgcattatccttggccgctcgtgttccgtggccccaaagtatcctggcgtcagagacaagttctgtcggaacccagtaaggaaagaggccgatggttggttcattgtggaatttccttgggggatctgggagacccagggagatcccagagggcatgggaagctggtctggagcctgtcgttccccaagtagatgcagcccttccagtgccgctctgtggggtcagtgaggaatgctgagctttttgtgcccgtgttcacatacttttttttgttttgagacagggtctcactctgtcgcccaggctggagtacagtggtgcactctcagctcactgcagtctctgcctcccaggttcaagcaattctcctgccccagcctgccgagtagttgggattacaggcatgcactaccacacctgactgatttttgtattttagtagagactgggtttcaccatatttgccaggctggtcttcaactcctggcctcaagcgatccgcccacctcgacctcccaaagtgctgggattacatgcatgagccaccatgcccggcccacagatacgtttttcagggctaattgaaatagacttaatgttagaaatgagtggaaatgcttataacttcatcgcattagatttgctttgatgttgggggagtgttggagttacactgttagaccgtgaatcatagtaaccccatgtttagatcctatctatggtggtgagatgtgtgactgggtgaattgatagcgcttccttagcatgaagtcattgactgtgaaggtgatgatggtgttgactgcagggactgtgaaaggattaataaaaatcccagagcacactgagcattgaatactttaaatttaacaactgttactggtgggaagtgttattgtattgatccagaaatcaaggctcagagaaatgaaatgctgtctttgaggtaagagctgtcaagtgtcagtttcaagtgtttggagctaggaacttctagtcactgtgtttacacaggatgtgaagccttcaacatggggcaggcacctagctggaccagtgagactcaggtactgccgttgtaaccattattgctattattaccatttccccatttccctgtcgttttagagcccttagcttctgtatttcacagtccacaagttgtttccgttgtcctgtgtcattctctaacggccgttaaataggaggcttctctcctttactctggtattatgttaaaagcatctatcttccctcttgagcccagcacagagctaggccctcaggaggtgctctgtgattcaggccgccatcactgtacaccttttccagtggagcacagtctgtgatctcattcagcagctgaaaggccaatactactaattctgtttgactttccaggtgtctgtgacctttgatgatgtggctgtgactttcaccaaggaggagtgggggcagctggacctagctcagcggaccctgtaccaggaggtgatgctggaaaactgtgggctcctggtgtctctgggtaaggccttccttccccctccaccatgcaggtgacctgccacttccttcattccatcttctgactccaggcctggctgcacaagaaggcctctagaatctaccttgcctctttcccacagctttagtcattttccacagtaacctcttcctatctggtctcctatatctctgggctaaagacagggtactctttggctcccagccaaaggagaaggtggtaaaaggaaatggggtgttttgcaaactcaaaggtaattttcagctgtgcctcatgaggggctggtgtaggaactgagaaccaccacgatggtgtcctggcttctctgtctgggtctgctcatgtcacgtctattctctatggctttttctgccttagtgagttcaagacaagagtggccacctggattagggttctctaaagggacagaactaatagaatagatatatataaaaaggacagtttattaagtagtaataactcatgattacaaggtcccacagtaggctgtctgcaagctgaggagcaaggaagccagtccaagtcccaaagctgaagaacttggtgtccaatgttcgagggcaggaagcatccagcatgggagaaagatgtaggctggtagtctaggccagtctagtcttttcatgtatttctgcctactttatatgctggcctcgctggcagctgattagatggtgcccacccagattaaggggggggtctgcctttcccagcccactgactcaaatgttgatctcttttggcagcacctttacagacacacccaggat

SEQ ID NO: 459 - DNA, 8000 bp, Homo sapiens
  Locus number 71 genomic DNA region, aquaporin-1 (AQP-1), aquaporin-CHIP, water channel protein for red blood cells and kidney proximal tubule, urine water channel
gtgtgggtgccagcacccaggcacggccagcctggggtatggagccggggcctctgtctagagcaggaaggtatggtgaggacctcaaaaggacagccactggagagctccaggcagaggaacttgagaggccctggggccatcctgtctcttttctgggtctgtgtgctctgggcctgggcccttcctctgctcccccgggcttggagagggctggccttgcctcgtgcaaaggaccactctagactggtaccaagtctggcccatggcctcctgtgggtgcaggcctgtgcgggtgacctgagagccagggctggcaggtcagagtcaggagagggatggcagtggatgccctgtgcaggatctttaagcagagccaggagccactggtcagttgggatggattcactgggaggagcattttctgattttcaccacctcctttcttagcagcctcagggactgggtcctttcttcccaccctccatcagggttctctgccccaattcaggaaagcctgaatgattctggaaaattcatccaagctgtgggcgagctgatggtgactagatggtcaggaccagtctgctgtctgagtcccctcctaccccaaactccatcttcctggtggccctcctggagggaatgaagtcactgtttcccctagccaggcttgtgggtgggaaatccctgctggccccagaggaatggtccatcccgcctcagcccctctgccctgcacttagcagaagcttctggccagtgatagcctcagccacacccaaggtctggaccctcagccaacatccgaggctccgtccactctcctccggatgaagcccaaggctctcccaccgggagacggggcccagacagtcctgggaacagccagctctggctggaacgtgggtcacccaggcacgtcaggaatgaggcacatctggaaaagcctttgccgagaccattgctgtcagcagggccaggcagtgcccagcttcagtggcctcaagccccgcccagggttcagaagtgggggtgggggctgcccccttactagcttggctcgggcccgagtccatgggaggacccaggagccagcagagggcgagggaacagcacctgctaagtcaggaagtcctggaagagagctgggctgcacacagtacctgccctggagcccagcctcctagggctcactgggaccacaggggtggctctggctgccctcagctcctctgttgcccactcttagcccggtgcttccattcccaccccaccaccctaattatacagggttgttggaggctgtcccctccctccctccccacccccaacccatcctggcacctctctgggcctgcagcccccagattttgtactgggatttctgtctggtaaccaggtcattgggggcccttcctgacaggtgtgcagagaactgcatttgggctctgggatgggggcatcctgagttttagtgccagctctgcctttccttggcaagtcacttacaatctgagcctttcggggttgcaggaaacaggccccagctggacactgtgtcctttcttcctttcttccttctctggttggcctggatttgtggcagatcagggaaaaggaggcggaggggttggagacgtccctgggcctggggctccagcggcaagcctttcccctttttagccacatggccgggtaacagccacagggcccctcggaggtggtgggcacgtgagctctgtattggcattcctggccgtgcctgcattctggtggcgcctcctggcgacagccatgccttcctccaaaagaatggcaccataatggtggtattaaaggcagaggccacactcacaagggggagaggttgggagatgcaaggggtggtggagtgacaccctgaggacccgcatagcctcctgagattggtgggcacctacttgcctggacaaaagtgctttgcctgaccacttccccctggtccccctggcctcctgccccaatgcagaacaagggcttctgctgagtgcacacacacacacacacacacacacacacacacacacacacacactctgcaatacctcgatcatcagccaccgtgtcctcacctaacctgcgggccctcacaccaagatggaaactgcatgtgaacaggagctggtctgtctggctcgtggctgtctcccctgtacacagagcaatgtctggcatgtgacacacactaaacatttatccaactatatgttggataaattagtaagttccagatgactctcacccacatgggccccctggaaaatcatgggtcctcggctgcacagatgctgacccagccacggacaccatcatggacacacgggacatgcctgggtccatgcaggcccgttttcctgtctctgccactctgcatggccacactggcctgagttcagtggctccttgcggcctggtgcctgctctgcccctgcttctttcctcaagtcttcttggctgggtcccagcacccgacagcctcagaacatagcagggcagggacaggtgaggggaggaggaggtgtgtatgtccctcagtagacatggtctacgggagatgcccaggagcctgtggcctgaagggaaatggccatgttccagaggaccctggtctaaggggtgccacccctgccctcaggagccaggtctgcaggagaaacagtttgccctccaaaacttcaaggtgaggggatcctagccctgcagagagagctctggttggacgcccctgaaactgaccagagagctcctcatgtgggtcagtgtccctgccagggcatggggccaggggccaggggccaggggcatgagggagcctcccagagactggaatgctgagccagggctcctcagaggaaaggatgtagaggagggcccaggaagtagcccagtggggccagtttcctctcctggacagctaagaaagtacttatgaccttcggccacctgggctgtctgagcaggcagggcctgctggccaccaccgtcctgtacaggcacttaggggaatgaatcttccccacctgcagccccagcaaacacacaccaggctggtccctggcaattcaccccaagagccaggccacagctgggcagaggggtggccagtaacagctggtgtcattctctgcaggatagcccctggacaagaggcataagacccactcatccttgccctgccccaggcacacttagaaaagtcctctcaccgggcctcagtttcccacctataaatgggaagatgccaacacgcccgagtgggactgtggtggggcaggcaggaggtgggaggagagcccagatcatcccaggccttccctaggggacgcagggggaccctcccttctgggcctggttcttccagcacgttccatgcagcaggcaagagggccaggcccaggggttcctgacagcttgctggccctggagtccagattcttgtttgttggctggcgctaggcctctggattggagatgcccggggcacaggcggcccacggggatctgcagcagggcctcggcccctccctctgcaggggctcgtctggtccctcccgctctctgcctctcctcatttatctctccctttctgcttcttggctctgggtccagtcctatctcccctgtttcagtttgtcttttcctagccctttgcgctctctctgtctctctcagccctgcttgtctcactgtctctggctgggggatctgtctctttcacttccacttttgctctatttccctgctactgtctttcctttctccttgtctgtctcttctcctcccctcagccagcatctgtctgtctctgcctttctctcctgctccctccctccctcctctccagcaccttccaatgccaggtggggctgccattccttccaccttcccagtgacccgccagtgtgactgccttgagaggaaagtcctaaactgtccctatcttcaccagcctgccctcaaatcattggttcaaatcgctgtcgagaagtttgggagctcccagggcgggggctttctaacagctctgcctagctcgggcctgccctcaaccgcagcatgcagggcagccacagacaacctctctgcaacttctgatgcctccgtgcccccatccacagagccctggctctgggggactggggactctgggacatccctaacatggcatgcagtggcggtgcgggaggacttgactgcccctctggagccctgggcccggggactccaggccagtgcctctctgggtcgggatggggatgtcaggccagcaggatcatggtacctgcctccagggagggcaacgtccacccactgagtccagcccgcccaccccacccactccggagcacctggctctgccctcaggaactccctgagctttgcacacagggccgagacacctggatttctctggttccctgagtggggccagcttggaagaatttcccaaagcctattagagcaacggctgcctcctgcctgcctccttgggctgggcagggctgagggcggagggagagagagagagagggagggggagaggaggaaggaaaaagttggcaggccgacagcacagccgtgtctgcatccatccagaggaggtctgtgtggtgtggggcgggccaggagcgaagagaggccttcctccctttgtgctccccccgccccccggccctataaataggcccagcccaggctgtggctcagctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacgtgagtggggtgtccctgggcttgggggggttctagaatgatgctgaaaggcactggttccatcctctgcccattgtgcagatggggacactgaggaacggagaggacaagaggttgctggaggtcacgtagagagctggggggaagagctggggctggaactcagctatgcatgcctcccaaagcctgttttctgccaggcactgtgggaagctgagatccagagaataatggtcttgccaatgtcccctgcagggcatctattatggggaataagcttggccagcagttcctcgccccttggctgtagctttttggcccttctcagtcctgcctgtgccgccagctccctcctcctgcagccctgcaccctggggaaactttgcccgctgtccccagccaccctgaaccaaatgcccagcctgtctgcagctggctctgcaagtgtgtgagcaggactccctcagggagccccccatattcacactagtttccaaataaaccacctctaggaatcaagagaaaggccctcttccactcttttgcccctgagattagacaaagataagggagtgaaaacactctctggggctgtttgaaggcagttttcctggattacagtatgggctggggggcaagcgctgggctccatggtctctaggcactgagaggtgtggcgtgtgtgtgcatgtgcgtgtgcgtgtgtgtgtgtgaaggtgtgtatgtgtgcatgtgtttgccagcatgagtctctgtgcttgtgtcaactgtgtgcatgtttgtgctgctgtgtaagggtgtgtgggggtgagtttgcaacacgtgcccatggctcctggcttgaatggggtctggactggggtcactaatgacaagcagatgctggtgactgggtggcagctgtggaaaagaatgtctcctgggctgcttagcatggcaaattggccctggtggcagctgcctgctgtcccagacacggcctttcccagctcctcagacaagtgcaaactcaggccgggcttgggccacagcaggggaggatttggcctgagagactggggaaggcttggaggatgtctctgagggcccaagggacaggtgagcaggcctgggggtgcccttacagggagggagagaagccaaggagcagagaggaggactcgtctagagagatgaggctggcggggctgtgggcagggcatgtgggtgtggggacggtgtgggccatctctgagggcgcctcagagatggcagatagtgattacagcagctgtcctctcgcttcccagccaaagttcagatcctgcggctggcagcccaggagaggctaggtgaaggtctggtgcagagggcagctggctcagcctggccatggggggcttagcacttctgtgtcacggtgacacctcacccaacctcctctgcagccaacctctgctaggcccaagattgaagattagctccgtgggctggagtttagactttagccagtttagacgtggccgcgggggatgtacgggacagagctcaggcaggccacatcaagctctgcccccccaggcctcagttgccagtgggtgcagagcttgtggcctcagggagttctgctgggtagggtcaagctcacactgaagcttggctgggtatgatgggctgggggagcgtccctgtaggggagtggatgtgatttccaggctttctggccccgtctcttccctcccatctcacagggcggagcctctgcacctgctggcgaaggcttcaccctctagtatgcgcatccgaggcagaggcgggagggtgggccccttctgtgccatctggaacagaggccacaccagcctcccgtgccccattccctccctggccttcattttttatagtcaccccaatacttgggctgggcgtgttgcaaatgggagagaaagaggagcagcctagtgtggggtccggccctgggctgagaggcagacacctgggttcaagacgtgtccactgctaacttgttgagcttctttggagctgcggaccctgaccctcgagagggaactcaggtcttgtgacctcacagccacacccagacagccagctcacttcattgctttgagcttatcacccatcccacgaaagctggctaagagcagcccagcaggggcagtgctgaacataagggcgcttagcatgatggtgggggctcaggcgctgtcctgtcccaacagtggaagggtggggttcaggacctcaactctgggcctagaaatagagaaggtacccctctaagggctcccgtcagacactggccctggaactggaggggcctcaggggtggcctggatgcctcaagaggagcagggaacagtctgggcagcaggtgacacactctctttcatgacctggggtaggctcctgcagcctctctggccctgagccccagcccagtcaaaacctgggtggggcaagtggttggcatggagatttccaaggaaaacagagaaagatgtggcaggaagtggttggggtgagtcagggggtgtcccttcgggacatgctggggacaactttctcctgactgactcagggctcaggatatgccctagagagaccgtgggcctccgtccagcctgcaaggtcccggctagttctaagagccaaataccaattttggctaagggtgagaggctctgaggctggggtggacactctcacctgtccctgtcctagctcagccactaacaccatgtggcatcacacaacagactggcctgtgtggccctagttcctgtctatgagatagggacatagcagggtgtgg

SEQ ID NO: 460 - DNA, 8000 bp, Homo sapiens
  Locus number 72 genomic DNA region, EGFR-coamplified and overexpressed protein
ttcactcttcaaagtgccaccgtttgtaggctaaatcacatggtctttctaaggaagggtgactgagtttctaaggggaatacactttccagggccaccactgccctcgcgatgtagagcatgcaaattcctaacatgttcctgtgtgcgcagacggcagaggaagcagagcatcgaggtggggtacacactggaaccagactgcctgggttagcatcttaagccctcacacttaacagcagtgttaagtgttcacttcccatttgaaacaaaaatgaagataaaagtaattgctagcaggattaatgagataacgtgtaacatttatagaacagtgcctggcagttaccctggagcactctatgaatgtttagtaagcaaacataaatatgcagttctatgtctaacaggtaagtaaatttctacaaagggatggtgaggcaggggaggaaagcacttctcaaaacagtctttggattgcccttcctactcaaggacctctcactaacacagaaacccctgcgcatgtgagattctggatggtgctagatagggccagggtgctgggggtgggaacagagtcaccactgccacaaggccaccccttaatttcaggtggtttatgatcaaccacgtggcaaatttatacactgaaaccagctcaggcagaacaaaggaacaaagacaaatttcccaggttgcagccggcagtcagaagccagaagccaccaaatagctccctgggttgcttttatgcactcaacctgaagagagccatttgccatggcacatgctccacacctacgactgcacatccatgtatgtgattcaggacttcagaagcatcacaggtattcatcagagcaccccaccagagatgaaaaaatctcaaatataaatctcatacataaaatttcatgtgataaatgatgaagaaatctccttaactcctcagagagacgcctctccagcacaaagtggtggtacttaggataatcatcatgtcaaagtgggtgacatcacactgtcccctctgaaacaatcatctaatatttgactgtgaaagtatcatcttaggcatttaggtttcagttttacatcacacttctgcctttaaggtcgtttcaactttgcagacatgatctgaactcctattaagaggatacattcctatgcaacgaaacagctattttggaaagaatggagtcactgaggccgtctaggctacatatagggcacagaaccactcagacagaaggcttgggagacatgggtggcacaaactagaatgaaagaaacgctaaataatttcatcaagtgccgattaaaaaagattgcagggccgggcgcggtggctcaccttgtaatcctagcactttgggaggccgaggcgggcggatcacctgaggtcaggagttcgagaccagcctgaccaacatgacgaaaccccgactctactaaaaatgcaaaaattagccgggcatagtggtgggcgcctgtagtccccgctactggggaggctgaagcaggagaatagcttgaacccaggaggcggagattgcagtgagccaagatcgcgccacagcactcaagcctgggccacagaacgagactccatctcaaaactaaagaaataaataaataaaaataaaaaataaagattgcaagtataggtacacacattaaggtacaagcacatctgttttcatgcgattactggtctctgattcacttctttgttctctatggtgagtcactcagagaatgtgattcctaaggttctaaaattctgaataaatggaaagaatgcaagcagaggcactccacaaaaacattaaataccaagctacggggatatttccgaacagaaacaggaagtctcggctatggcagagcctggagcaaggagaaatttgtccaccagccttcctttcaggaaacacttttcctccaacattttgtaataattactttttaataaagggcgaagacaaactagtaatttccagcaccaatcactaactattaaggaagatagtttcacaacttcctaaaacagaggcatgggattcattacctatttcttttgacttcattaatttaacgcaaatttccttcagaataatgaaactaaggagaaagttgaacaagccctgattcagactggacaccccagaattcctctagttcgcattttaaggaacctgctttagtgagaagtatgtggccccatccgaggatgcaatttcacagccaggagcagccgcggtccccgccagggatgcggtcacgggcgctcgcacccggaagccgctcaacaagttccccgccggcttcggctccgcacccccacccagccaggctctccgcagaatttcctccccgcacctaaaggctgcacttcattttcacacgcgggaacgcctcctcccgctgctcacctccacaactcccggcactcccgcgacacttccccacagtcccctccgcccgctcccctcaccccggctcggcacccatcctttcctaaccccaaactgcccggcgccccgggctctccgcgcctgcgccgcgcccgaggaccacccccgcccaaccccgggtccatccgatcctcggccctctgcggcggggagagggggcggacggtgcacaaaggtcaccccgagctaacggaggcggtcggcgcgggaaacgcgctcacccgcagggtgggggcggggtgcgaaaaccgaaggaacgacggaaggcgcggaccggggcgggagcctccccgtcaccagggtcccgcacctcccagctccgggaggcgcgcagggctgtggctccccgtcgctccaccgtctgcgctcccaggcaaggtcctctggggcgcctcggaactgcgcgcccccagccgccagcatggtgggcgccgcgcctccggcagcacccggtccccggcccctacctccaagagcagcccgagcagcagcgccgccaccttcgcaggctggcgcctcatggctcctcgcgtcctctccagcgcgcccggacgccgggtcgcaggcgcgcttcgcgactcggcccccgcgcggggcgggcgggcagactgcagccgggagccgtcccgccgaccgctggggggcccggctgggagcgggcgggagccggggcgcgccgcgcagccctggctgcgctccgcccccggccgccgcgcgctcccgacacgcccggccgggcgcgcgcctgcgggctcccggaacccgaggcccggcctggggcgcggctgctgggcgctaggcccgcgacgctgaggtgcgcgcgccccgggcgggaggaggggctgcaccgcctggcgaatgggagggggactggcaggctctcccttcccaagggaggtcgtcctgtcgccctagactaaacccaggaaggcttttaaaagaagcagagtctccgcggggggaagcttgttccctgagaggtggccgcagacgaacccactgctcagtctggcatcccgaagccgctccgctcctggctctccccgctgttcctgcgcgcagcgggggcagtgcccccacacccacgcgtgatgggaaggccggcctgggggtgggaaggcccaccgaaatagatggtccccacacctcactgcttccttggatgtggctattttttatgccagtgttctcctgctctgaccctacttgaacttgaccgcaaccggccccgccttgcaggccaccctcccgcagcagaaaactgtgcggagctcgcgctgtcctcgcctccgctgaccccacctccatgtcctcacagacactattttttcacaacacagctcagatcccaccttcttcatgaggttattcaacaaacactattaaacttgtaagatgtaccagatcctgagttggaggctgagaggaggacaagaaaactgctcccgtagcctagagggagggagagtcgcttaaaccacctgatgcagaatgctgagtgcggagaccaggaggtgggtgcatcacagagggtcataaaggacatgagctgcgcagtacaggaggtggaaggagggggtcacacgaacagatgtcacccgaggcaagtccccaactctttcccagctttcaaagcctaatttgattaatatagagcatgcaccacctgactatacctgtcagagccagaacttacaagtaagacagaaacaatgcctatggccttcagtcatgctaaggcacctatctgacaagcctgccaaacgccattgaactctagtagttttactatttacaatgaggacattttacaactctttttaatggaaaagttaacttgtagaaaactaagctgaaagcttattgtgtgttagcaagacaaatgtttttccagtggggatagaagtgatctcgtcctgtaaaaatgcaaatgggccaggcagggtggctcatgcctatcatcccagcagtctgggaagctgaggtgtgagaattgcttgagcccaggagttcaccaaccccaacctgggcaacacagcaagaacctgtctccattaaaacgtgtgtgtgtgtgtgtgtgtgtgtgtgtataagacaaatgacccctgcttaaggtgagaatcataaccagcttcctatctgattgagccacttcattcccagcgtttcctttctcttttctccccgcttttgactgtgtgtgtaggtcacttgcctgcattctcctttgaagcacctttgtcatcccactgtttccatcattaatgggttaaaatggaactttgacttgtgtccacgatgtattcgtgtgcaaattgtggttctgttgcattgtgagcaacctactagtgtctgacataacctcccttctgcatctctctctgcctggaagattgttttgctgagctcgacttcctgtaatttgtgcaagtttttttccaagaataaaattagaactgtgactctgctttcacctcagtctgatacctctcctgtgtgctctctgtttggtcctgaatgatgtggtggttgcttggcatggttggaggatggggtgtaggctaaccagccaggctgtttccttgagcacaaattataagggcatcagataccactgaaaaagttacaagataaagctgcattcactagaacaactgttaaagttggacttggggttagaagaaagttcttgatgagttgtttggggcaggactggacatgtcctggtctgctcagctgcccctgaggagtaaggacccagagcctggagcatgtgtgttgccaaaggaaacaaataagagagagactgggcttgacctgtagcttccctgcaaaactgtggagtctacatgaatgatgaacatgtatttcatttattcaataaatatttatctgcatctgttttgggccaggcactattctggacatttcggatacagccctgagtaaaatagacaaagcagtggcataaaaggcagagtggctgctgtcatgcagatttcaatctagtgaggggtaacagagaatagaataaataaataaatatgtatataagtgccagaaagaaaaataaattgagtgaaacatttggaaggtaagactgagtgtaattaaaaatacaagggtcggccggacacagtggctcatgcctgtaatcccagtactttgggaggccgaggagggcagatcacctgaggtcgggaggtcgagaccagcctgaccaacatggagaaaccctgtctctactaaaaatacaaaattagccgggcatggtagtgcatatgtctgtaattccagctactcgggaggctgaggcaggagaatcgtttgaacccgggaggcagaggttttggtgagccgagatcgcaccattgcaccccagcctgggcaacaagagctaaactccgtctcaaaaaaaaaaaaaaataggagggccaggccaggcccctatggcaaattgccaggagcagagacccaaaggtaggaaagggggcaaaacaagactattaatcaaagctttgaggcaggaaaaacgggcctgaggaatttcctgacaggatcggtgaggctggagctctgtgctcccttagcaggggtagaatctgaattcaaagaagaaatggacgctcagatttgtagtccattataaggatcttggatttagttctgaaagaaatgggatatcatttgaggattttgagctgaaaagtaatgtaatctggcttaagccttcaaagcatcagccctagtgctgtgtagaaaacagactagggcagggttgggaagggtggagggaagggtggaggctggaagagcagtgaggagatggatgtgatgttgataccagtgggctaggggaggtcccccaaatgccaaggggatcttgacctccgccggtgtccagcctcttgacaccatcacaagaaggaattcaaggatgagtcgaaaatagtgaaagtatgatttattgcaaagcaaaaagcactcaagaaagcgattgctggcatactcaagagagagttgtgcaaatggagtttggggctgctactacctttatgggtttctttaatcaagaggtggaatattcatgaaaatttctgggaaaaggtggagagttcttggaactgtgatgcaacccatttgtacaccaaatgtgggtgttcttggaactgttatggcactggtaagtgtgtgatttagtatgttaatgagtgtataatgaagtcctaggtgaaacctgggtcaagcccagtgctatgttggatccagtcagtcttagccagcttggtccacaccttcgtttttcggggtcttaacagcccacagcctctagtcatgtgaaactgctccctggaattttttattctcctgtgatcaccctgttttattcttgtgtcaatgtggtccttgtgccaacaaaaaagagtcaacctttgtaaaatatttgaagagatttattctgaggtaaatatgagtggccaaagcccaagtcagtctcaagaggttcgagaacatgtgcctaaggtagttgggttgcaacttgattttatacattttaggagaacagaagttacaggcagacatcaatcaatacacgtaaggtgtacattggtttggtctggaaaggcaggaaaacttgaactggggattaaggggccttccaggacatagatattttcaaagattttctgtttgccaattggttgaagaagttaagttattatctaaagacctggaaacaacagaaagtcgtgtctgggttaagatgaggcttgtcccacctcctgtcccatcattgcctgaactagttttttaggtttcctttgggattcccttggctgagaggagggatccattcagttagttggagtcttagaattttatttttggtttacactcacactccctggtgtctgcattcagccctctgtatcatagttgtttaagtggctatttctccatttagattccaggcaagggatgaggtgacttgttgtgttaaatcaagtttagcctaaagttcatacatgtttaagttcaacctaaagatttttctgttcatggtgaactataacaagtggaggtggaaacaaaccatagcctacacttgtgccaatcaacaagttttggccaatcaaatgtagccaagtgttcaaactgtgttcaaataaggcaaacgctgagttgcaaccaatccagcagtttctgtgcctcacttctgttttctgtagatgactttcctttttctatccataaatcttccaccatgtggctgcgctggagtctctgggcctaccctggctcagagggccgcctgattcatgaatcgttcattgctcaattaaagtcatttaaatttaatttgacttcagtttttgtttttgttttatttattattatcatactttaagttctagggtacatatacacaatgtgcaggtttgttacatatgtatacatgtgccacgttggtgtgctgtgcccattaaatcgtcatttacattacatatatctcct

SEQ ID NO: 461 - DNA, 8000 bp, Homo sapiens
  Locus number 73 genomic DNA region, ubiquitin carboxyl-terminal hydrolase isozyme L1 (UCH-L1), ubiquitin thiolesterase L1, neuron cytoplasmic protein 9.5, PGP 9.5
tctgttatttatgttgacacatggacaaccctagaaccaccaacctccagtcattgagttaagagagggaattcatgtcctaagctttcagtcagttttagttgggtattctgcccttggtagacatagtataatacagcggtccccagcctttttggccccagggaccagtttcatggaagacaatttttccacggactgggggtgggaatggtttcgggatgaaactgttccacctcagatcatcagtcattagattctcataagaagcacacagcctagatccctcgcatgtgcagttcataatagggtttatgctcctatgagaatctaatactgctgctgatctgacaggaggcggagctcaggcagtaatgtttgctcacccgccgctcacctcttgctgtgccacccagttcctaacaggccacagacctgtaccagtcctcagcctgggacttgaggactcctggtataatatagtacagtggtcaagagtgcagactgtctgtggtcaaatttcagttctcatgacttaaataaccataggcaaagaacttaacctttctgatcttcatttctaaatgagaataataatagtaacctacctaataggttgttatgttgattaaaagagttaatacacagaaaacacaaagaagtagtgcctggcatccgtaagcaatcagtaagtgttagctatgattatgctgctaaaagcatgctcaccattacatgtgaagaatttacataaatgttgaaccactctaattattaagtgctttcttatataaactaatattttcatctgacttctacctgtctgtcctgtattcttaaataatcataaagattattctcgccctctttgtatttttgagcatttggtatcatgtaactcccctccccatcccccaaacacacacacaaaccctttctcttctccacatcatatactgtcttctcaatttcttcaaccacctttgttcattattttggcgctcagtctctgaaaactctctaatatgtcaatgtctcttttgaagtgtggtagttcgaattttcagttgaaaagtatttattgagtgttcattatatgccaggctgggcatcataatccagttatagtctggtcaattctgtgagtggattagatcttgaatattatattaatctagccaaaggttagcaaatacctggttatccttaccacttccctttcccatactcgtggtagacatcactaatcaatcacagcatttttccccctactggactcaggactctccttcaggaacctatgattaaaatgaaattgaatctctcactcctggtataaataaagattgcactagctttatagtcaaattatgacacctgaaatatttgaatctttttctcaggtactgttcacaaagccagatctaattcattaatgcatctgtaaatgattttttttaaaaaatgtttttccttctgatctctgtgtatttatttttaaaaggttacaatcaaactattgtgttgttttcacttgatattttccaaattatttcatacttttgcaatcatagcatcaagaaaaaagttaatataaagattaactgtatggcaataattgacaactgttactataatatagagctttacacatattcctgttacatttttaatagctttattgtgatacctaaacccactttttagttttttagtatattcacagggttatgtaatcgtcacctaaatccctgttaaatttcatcattttattttaaacttattttttaatcccaaaattctgccatttattatgtatttatttattttaagagatggggtctcactctgttgcccaggttggaatgcagtcatgccatcacagctcattgtagcctcgaactcctgggctcaagcaatcctcccactttggcctctcaagtagctgggactgcaggtacacaccaccacacctggctaagaattctgccatttagactgcttgttcttgcttgtatgcacgacctctctttttctctgctgtaataaagtggcaccagacaaggttaaaaccattgtcaggtggctacaggttgaggtagctccatccagtaccacttttttttttaaggtagaatcaattaaataagctataaaaccacctcaactgtggtatcaaccaatgccaaccctggcagcataagaaatacaatgacagtgttctacctgtccatccagttaataacccccaaagaaaagaagataagttctggctggcataacttgttctaaatgcatccatcttattgtttctaaaagtaaaaaattatgagtcctaacatttggctaatgactgatataaactcttctggcctgcagtttcagcagtatattcccaatcaccccctacttcttcttcttcttcttttttttttttttaaaaaagattaggcttaggtttgttcatatccagtctctggcatctctttgtaagcagggagttgtttcattcactgctctgatgcttcctggcaaacagtaggccatatatgtatatgaatgtgaatgaattaatgccttcaacaaatatttctgacagtgatttcatgactgcttttattagttattttggcaatcacttataactgctaacgtctgcttgccgatcagcccttagcttaaatgtcacttccttcaggacgccttcctgatcccctccactaggttaggtgctcctgatctctgctccctttcatacaactcttatgactgataaaaacagcacgagggggccaggcgcggtggctcacgcctgtaatcccagcactttgggaggccgagacgggcggatcacgaggtcagcagatgagaccatcctggctaacacggtgaaaccccgtctctactaaaaatacaaaaaaaattagccgggtgtggtggcgggcgcctgtagtcccagctactccggaggctgaggcaggagaatggcgtgaaccggggaggcggagcttgcagtgagccgagatcgcgccactgcactccagcttgggcgacagagcgagactccgtctcaaaacaaaacaaacaaaacaaacaaacaaaaaaacggcatgagggaaatttccatgtttattgtgttcatctttgtatgcctaattccaaactttccaagctcggcacccagcacacagtaggttcttaatatttgttgagtgaatgaataaatgaagtaaattggaaatgtaatttgtctttgtctaaaggcaagaactcattcaatataacctagtcacttgtcttgaccttcacctctttttttctttaacaaccttattgagggaaaatttacataccataagattcacccattaagctcctcttactaatttttttctctctcatttttgtgtgtgaaggtcattttctaatggcaaaaatggaaagaaaatagaagtagaatgttgtggaatcttagataaagaatgggctcttggagcccagtttagcagggtttacttctcagttttacttttcaattgtgaccgtaagcaaattaacttctctaggcctgggattctgatctgtaaaattgcactaatatgagtctcttcacggctcctctaaggattaaatgagagacacatgcaaaggatccccaaaaacaataactcaaaaaatgttgattccctcccttccctctgtcatctgttaacctcaacttcctaaatagaaggtctattcttttaccatcatcattattctcttcggtgcctatttttaaaaaatactcaaccttcttgcttccttcgctacctaagtatttctgcaagcccactttgttctgcagcttagctttcctggcacaattcttatagattttggtcccttttaaaattcattcttcagcaaatgctttctctctccatcttttgactagagatcattagagatcacctgagatcattagagaacagtggtttccttggttgccattccctttcttcttcattgggagtattctgcggtgaactcagacattttatttttcaaagcttcccattcttttaaaaatgcttttccttttacagcctctcgctcaaaatcatacccatcttttccctggatctgttttctcaagtctccaatcgcctgccttctttgtgtcttgtattaccctcacatcccccagctttctactgctctcccaggaccaaccatttcttccgcgggagtcacattacatcagcattcctaatgcagtatctgttatctaccagattctgttttattctaggtagtcacttaaaaacgaacctcggtactggtctgacttaacatggaggaggaattgtctaaggttaaacgcaaactgctgagagatttggggcggggggcacacatttacattcattcgtattaaatatatacctgttgaatttgtgctttttctcaaatgcttcagagactcgagctttagagtaattgggatggtgaaaggatgggtttccagaaacttcgcccaaaattaaagactccatcaaaaggactgctccatacactcaaggaacacccaccaacaaatcccgtctccacaaccaccagattatctcaccggcgagtgagactgcaaggtttgggggcccggccgtaccactccgcgctgcgcacggggggttcgtacccatctggccgcgaccgtccgtttccccctcgcttggttctgcccctgctccccctgcacaggcctcacagtgcgtctggccggcgctttatagctgcagcctgggcggctccgctagctgtttttcgtcttccctaggctatttctgccgggcgctccgcgaagatgcagctcaagccgatggagatcaaccccgaggtgagcgccaggtgcaccgctacccggagagcgcgaggccgagggagggggagccgagtcgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccaggtagggcgtggggcccaggatgcgccggccgccggcagtgcacgccgctccccagcttgagtcctcgggggctccccgccccgccccctcccctgtaggtgatgcggggcgcgcctacaaggaagggaggagcctgcattttcgtggtacctactccctgggctcctgttccagcggtgcctgtcgccttcttgcccatccgtccacaattgccttaaatttggaagagaggcagtatctcagttccatctatcccgttatccagggaaatcattcatcctactcatgagttccctcgaacttgggctttttcgagcctccggttccggggaatggctgctggtttccctttaagggctataacctgtcaactcattgtttgcttctcagactcccacctagctgtagaatggagggggaagggctgacctaaatcgcagggaaacaattaggttcgctaattctccgcctccattacttgggtttctgatggtcttaaggggttcttctctcttctccactcccaccacttgcacacttggtttttagcctcttgaatgtatttcttaaagcttaatcattttgtgtatggtttctgtgtgggaacctccttcctcttcacttatccttgttcatctctgaccttgtagctaactgaaatagggggttattagctcagttttgaaagcacctttgcatttcccttgaaatgattttcctcctacaagtgtgcatggatagatgtatctgaaagacagcgtcagatttttttttttaaaggatagctaggatatttgcagtcttgtgatgtatggaatcccagtcattagcgcatggcattgtcttatctcctattgctgtcacttgaccgctgatgtgggagtgactgaaattagctttagcaaaacttggggcatcactctaaagagtgaggttaactgaagcaccgtcctaaggctaggtgttctggaagcatctgtagccaaaatcaagagtatgggaagttccaagccttcctcctagtaagtaagctaagtattgtgggtaaaaacacttatttacagctaataagatgatctcactgacatgtttttattgctaaagtcttttacttgggctaaaaggaagatgccaaattgttggaagtcgaattagcttcctggttgaccaaatcagtctcctgtctccagttgagcatcacacagaggttttttattagagcaaccatgatgactcggaggttttgagcagcattcagaggcaaggcctctgggaggcagtggtgcagcatgtttgcctttaaaagctgactgttctccttttgctgaatcttgtttagagaacattctagtttgtgttatgtttgaaagagctcgatactttgtcctttagtttcaattcaacctatcagatttatcgagcgcctattctgctacacagaatgcctactggacaaaacactgaagccgattgaaagaaaagttgaggttttataggttgactccaaagatgctaatgttaatttggaaggcatttaatttttgactaagggaatgttatgaccccctacatggaccacttctgaaacattaagtgctagtagactatttacagaatgatttccatggaagagctcaagcagccctaaaggatggtgctatcccattttaacatttcatctaattagcctagaaaatgaaaaacacttactggtcaatgaatactaagttgaggatccagttagatagaagcgaaaaagttctgctagttggagtttaagttgatcttctggggtaagagatcttactcttctattagtaccagagagcaagcttaaacttcagttcatgtacagaaatgcaaagctactagaattggaaataggtttctgatggtctgtctggttttgctcgttatgggaaatcagtgtttctatagtgttagtaccctactctttaactgggaagtcctaacttatttattatatttttattttttagagacaaggtctcaaacttctgagctcaagtgatcctcctgcctcagcctccctagtagctgggattataggtgcaagccactgaccctggctcaagaaatcataacttctaaggtctttaaagctagttagtgaaaagtccagataggcttactaaattactatacagaaagctagcagatgctttgaggaaatccgtttcctagtccgattcatttaccagtctctatcctcctcctcaaattgccagtctgtcctcaaagtaaactgtttagctggcaaggacaagctagtgtcacatcttcctcttgtaaaatcacagcccaataccctggatcagttgtcttttccttaaaaagagggcggaggtaatggttaatttctttcacttgtt

SEQ ID NO: 462 - DNA, 8000 bp, Homo sapiens
  Locus number 74 genomic DNA region, homeobox protein Hox-D12 (Hox-4H)
tctcctcaatcctcaaaaagaggctgaatcaatgtggccgtgggtgggaacttacatacagaacccaatgaagaacttgactgtctaaacaagggggcctcgcatggagctgtaaagcatctaacaaatatgaaaaatgtgaagttccaaggtccaagaagaaaaataatgatgtttctgaaagtgatgataaataattacttttaaagtgctgcatatttatacaattgagagattatttttgtaaatgcaatgtctgtgagctgggatacatgggcagtgcttcagacatttaaaaatcactttttactcctagggagatgccaataaacagaactcttttgtttcttctgagtccttatacatttgttttattttttcaagtttgtgtttcttcttgaaacgattcttatttattacaaaatcttggtatcttgaacacaattatgttctctatagatgaaggaaactcaacactaattctggtttctggaaccttcatgctctccacttttgcccccctccctcccttttgcccatgactttaacataagtagtgatgttttaaaatgaggatatcatttacagtgtttaaaatgatattttataccaggccagctcaaaagacaataaaattttacttttctttcactattgtcaatttatttatatagttctatttattttttaatccatatgtatttgtatgcctgtgcatagaaaaacttactcacttgaaaattttcaacctggaaagaccattataaacatctggactaggaaggtcttgaaattagaaagacatacccatatttggcaatcgaaaaagaaacatttcaagcttatcccatatcgccttctccgggcagtctgcacagagcagttgacaactgaaaacataaaacctaaactttcagacgcaatttttaggcactagaattttctgtttgaggcctttttgccactcagggaaatggccgatgaggaactggatgactcctcatggttagctccccacacaatcaactcagtggttgctaaagttttagtgtgtaagttagttacatagtgatatttaaaacctcacttagtgtgaaaactctcctggtgggagggctccctcatgactttgagagagaaaacgcagagacctaagacttggagctactttcgttttccctgtcccagcttgatttctttcatatcttactggcgaccgtggacagctaacttcgattttgagggggagggacagagacagagaaacagagagagatatgatcgcgattcaatctttgcagaagaaataacccgtgcacaaggggccacaccatcccccaccttacacttcgggaagggtcgttaccgtttttgtggtttttctcaaaagatgtgttttcatcagaaacgggcacatttttcctttctcctaatcgccaacttcccctccattttttgtgagtcccacactccggagcttcactccatttcccctgtctatttctcgggtttcccatcgtgggtaggggagattgcctcgaggctttcctttcatctctagtttgcatgtcacttccccccctccccccgccttggagaaatggtaggtttgctgaagattaaaactgtgctcaaacgctctctggaggaatttggattgagggctaaatcaataacagaagaaggctttgttattcatatgcattccctttatattccaaattgcagagggaggagaggaactggtaagtggcccaggcactgggagggaggccctcggggaacccggaaggctaagggggcttggagagaggcctttccttcggttggagacaggcggcaggagagctcctcagaaacccggcaggtttttagcgccgcgggtgggggaacgaggtccccgtgtcgcgtgattcaagaggcgaaggaagcattggagccgggactcacggtcagacaaaggggcgactgcagtgcttccccgcctctggcagccccctgggtccctctggctccgctgtcaggggcggccttgccgccaagatctccggctttcggaggcgctaggctgcgtctgaaagcgggctggcgaccccagggaggccgcaccgcccttcactgttgatcttgaccgtgcggctgcgccccgataggcatggagcgcgctcgccatctcctgggcattgggcggcattggcagagctctctattcgctcctcagccaaatcctgttccattctcttaatcaccagccaagccactctcccgccactactttccaccccgatcctccctcgatcaggttccccagctcgcataagactttgcctgccagacctcgaaagtcataaacccgggggatgaagtgggaagactgtccaaggagcaatggagggaacctagttgttcttgtttttcctgtttttcactgagttcttttatgcctttagtcctgaggcgcaaacagctgttgtagggctgcctaaaggtccgaaagagacacccctcggcttggaaataacgaggaatcgtcgtgcactgaaacgtgaggagagactgcagggacccctggagctggagctttcgggagtaacgaagctgcagctcctcgaaaataggatgggttccccaaaataagagctcttagggatctgaggcttgtattcccttgagtatctaggaactgggattgcagtttgtgcttgcccccacctcccaagagaggacgagagcgagtgagtctctatgcctgggctcctaaggaaactctctggcagagccagaggagccccagacatccccacccccccgtcctcactccctctctcccccccaccagagcaggaggaagaggccgattgcgttccccagagccacccaattggtcgccataactcacacaataaagtggcagcgcggcggtcagtcttgccctccggcggcgcctgtgtggtctcagtgcaggagcccgcgatctaaccaattccagcttggctcggagaccgagggtcctgctgcaggctgagactggcgccggtcaccgggtctcccagggtcttgggatcagaggcaggaggggaggacccctagtcctctggccggactaggcaagagggccagcgacggggtctgagcacaccgctcccggctaagaactgctgcctttcccacttccctgtttgtcagacccgtgaactccctatccccggcacccctgggggcgctgaggcaaggaactctgctagccagctgcctccgaacgcccgctgttccccggccaggtggttctggctcttctgcctttccacacccagtcgggggagttcgtcctgctttgccctccacttggtggatggggacacctcggagttctggtttgcagtgtgtagtcctggagaggactcctgaagataaaaggaatgtagcctttggccacgattggtggatcgagctgatgggttccctggcggacattctccatggacctgtatggcaatttccctatgatcagagttcttagccatggggacacaaaccagaaatagtgtggcctccttcctggatcccaaaattgggtagtttgtgatgccctttttgtgtctgcggcctgggactgagggctcaagtagcgaatgggtctttgctgccagatcctcaggcagaggtctctggagaaaccctctctgtgggagtgattggggtaaaagtgacattgctcaggccaagggacagagctcctggtgccgccggaccgcgccctctccggataagtcgagaggcgccggttaatggaaaatgcctccgctgcaacttaaagccggtagaagcaagccgggcccagaaagcctgcggaaaacgaatcgcaaagccaatcacgaccaagaagagtcccaggggacacttgggcagagtcaccctcttgcccgatgtccccagctgctgaagccgggcctggaaacccgcagacagttagtcttcgctcaacctgatttggctctgctggcagcctcgtccttcgccatcgaacattgcgggtgttatcataatactctgaagggggggaaaacgggtcggggggatgtaggcggtgctgaaatgaccggctttgaagaacctgcaggcaaagtttcgtccaatcgtctgagcctgtcctcttattcccggttgtaactaaatactgttgcgagcgcagccgaagccctttgttggagatgtgtgagcgcagtctctacagagcgggctatgtgggctcgcttctgaatctgcagtcgccagactctttctacttctccaacctgaggccgaatggcggccagttggccgcgcttccccctatctcctacccgcgcggcgcgctgccctgggccgccacgcccgcctcctgcgcccccgcgcagcctgcgggcgccactgccttcggcggcttctcgcagccctacctggctggctccgggcctctcggcctgcagcccccaacagccaaagacggacccgaagagcaggctaagttctatgcgcccgaagcggccgctgggccagaggagcgcggtcgtacccggccgtccttcgcccccgagtctagcctggctcctgcagtggctgctctcaaagcggccaagtatgactacgctggtgtgggtcgtgccacgccgggctccacgaccctgctccagggggctccctgcgcccctggcttcaaggacgacaccaagggcccgctcaacttgaacatgacagtgcaggcggcgggcgttgcctcttgcctgcgaccttcactgcccgacggtaaacggtgcccatgctccccgggccggtttgggccgggatgggaggtggggttcaagggagagtgtaaggggaggtgaaccgcctgggggcgggcaatagacagagtacgggctgggttgacgtgggttggggctgtgttgcaggcctgccgtggggggcggccccggggagggcccgcaagaagcggaaaccctacacgaagcagcagattgcggagttggagaacgaattcctcgtcaacgaattcatcaacaggcagaaacgcaaggaattgtccaataggctgaacctcagcgaccagcaagtcaaaatctggttccagaacaggcgtatgaagaagaagcgcgtggtgcttcgggagcaggcgctggcgctctactagccgcgcgcgtggccagggccgggttggatctgcccttttggacagaggccttgtttggggagggggatctggggctaaggctaaggcttttccttcggttccttctctgctggccccagaagccaccaagagatttacagaccaggccagttgggcctccttgctttcctcagtccctgagaagcccgtgagaaacgtgcggaagtaccagtgcaactctggctggccttaaggcttccacgttgggggactgaggccaactctccttgctcctggctggggcatttgcacccaccgctcattcttgctccccggtacctggatttttctgtttccacccaattcgttctccctttccccctctctccagccccttcagcgtatagcagtcgcctagttagggctcagagtggaaggcctcctgagggaatggaaaggactgtgggtacaattaggtctctgcagcagaagccctttgtggcaaggccaggatcttcactctggagaaaggaaagggcaccatccaccctccaccctcctgtctgccctggctgatttgagagaacaaaagccacactagatcttcagactttgggaggaaaagggagggaaggggaggggctgggtagtggggtaaacttggagatatctcgaaatgagaaatgcgaaataggctggcctatttccagctgggtagaatatgtggaaccttcatttcctgagatgggatgagagagactgggactccagacaagtgccatctccagacaagactggcaaacattgccctactcccaccttctcaaacatgcctaggccaggcctatgaaccctgtaactggatccccagaggctagctctggtgaaaggagctgttggtctgctttgaagctctgttgcacagggagagggaaaaatatccaggggaggagaagggagtgaataagaggaggaggggtgctgcactccaactgtaaatatggctttccagttgaggtgagtaaaggtgttggtgcatctttctttcttcaattaccttaatggaaccccataaggataggcaaaaatccttctcaagagtcaaggggaggggaaggaagtctcttagattctctgccccgctagctgctcttgacaaagcaaagaggaccagaagttcctctcaccgtctctaccatctgccaactctaccagaggcccagctactgtgccccttctgaggcatgtctggcctgtcccagtggagactttaaggccctgggccctgccaggcttgcctcatggaggcaggggttcccaaatgccaggtggagttgttctgggtgtactggagtgtcccgccttaatctcagtgaaccaagcctccccctgcgagctcattccactatccctgcctcttctcccctctccttctgacatgtagcactcctccttcgcaattcctagcatgatgcacaacaactcaaggattcaggattccttcccaaagtccagtgatttcttttcagtgcaggacctggccctaaatctggagtgggcccctcacagagagccctgagccttagcccaactgacttcagttgatatttaaactaatttcattttctaggctatctaatagttatcatgcatgttttgttttgattttgtcaaaaacagtagcttgtatatatcagacacaatatatacaaatgttttgagtgaaaataaatatccaggtctgagccaagctgtcaaggagctgaagtcaatttttcaaaatgttttggattccaccttaatgtttttcaggccaccaaattcgtttttcttttctggttattgtttcaccgcgagtgttgactgttcgttaaatgagaaaatggcttccgaggcagtcaggaaatggtgtgtaaaagcctacaaaccaaatatgtttggaatatccaaaagggaaggaccatggcagatctgagtgtgtctcacacattaaggggactctcagcttgttgcaagctgggacttccacacttagcctaaattctcaaattttaaagcttgctggtattcggggtctgtaaagatttgaggttcttcagatgtcaaaacaaaacgtctgtctccaccgaattttggtctgacttctctggaaccggctatgtcctgctaaatccttgataccagcaggtttaccaggcgcccagcagactcccttgggaaatggggcctcaaaactccctagtccatctgaacctctagcttagtccaggaaattcagggcctgcttgctactcattttcttgcaaaaacaagctcctagctggtggaggtggaaactagcttttagctagaggaagaattagcaaaaccactaaatcactaacactgaatattcaacatttcaactccctttcccagaagcaaatttggtgtataattgaaatttttaattgttctttaattgtatacacacacacaactatatatacctatatgtatatatattcaataggagagaaagaagcaagagctgccaaggccctatggctcaaaaggattctccacctggctgggcacatagaggcgatggtacccagagcaggatctccaagtctgagtctgcattcagaggtttgcctcctcaaaaacaactgaacaaaggctgaagccgcactgagcgctcggaaggctggggaaaggaggaggaaagcatatgaactcagatccaggccttaagacagaaaacacggaggccgtttctttccaaaatatatcattaaatcatcgtgttctttccctttagcctgggatgagtggggggaggggatattcatggagatcactcctcaaa

SEQ ID NO: 463 - DNA, 8000 bp, Homo sapiens
  Locus number 75 genomic DNA region, homeobox protein Hox-D9 (Hox-4C, Hox-5.2)
agctctccgctgcccagctgcagatggaaaagaagatgaacgagcccgtgagcggccaggagcccaccaaagtctcccaggtggagagccccgaggccaaaggcggccttcccgaagagaggagctgcctggctgaggtctccgtgtccagtcccgaagtgcaggagaaggaaagcaaaggtcggtatgagcagagttgccaccccagcggggcgcgcagcccgggaacccggcagagagggagtgccggggtgcccagcgccgagccggagcccgacttggcaggtgctgctccgcctggttttagaggggtgatctcagccctgagatagtccccgcttctcccctgctgccctggccctctccgccagtcctggccccacgctgatggcgcccgggcagaggaaaagcttgccggttttatttttcctgagctagacctgaacacaacaaaagagcgcaaaggagacctgcggctcataaacacgaccacagagcctcttttctcctgctcagatttgcagttccagttttgccttgagcccaatgatcatgttaaggtgatccagggcaccgtgttcgtgttcaagtgtatgcaccccgcatcctgcgagcttgggggtggtgaggggaaagagatggctgggctggttggtgcttgagttgggaaacagggcttactgcctttgctgggctaggtaaccttggctttgtttaggaaaagtgctgcagtctttgcaatccgtcggcaaagagggcaaaggcggagggggagagtggaacccgcattgccctccctgcaaggccagccttagggctgggctaaggcaaagagccagggatctggctttttgagaaggaaccctcctcctctcccccagtgcttagaggtgggccacagtagggggctccctttctgggggaatgctttagtgtgggggcaagaagacatgaaaattaaggaaattctggggaatgcaacaatacccaggcaaggtgggggaaggtgtctcgcttccccatttatcttttgaaagagaatgggcacctataaacctgactgtcaggattcctgactgcctaggagaggtggggaagaagtggcagatttggggacctgaggcagcagtggggttggtaggcttgtccaggtcgtggcgtattcccctccgtccctgttaggagctgaacccttagaatgttgctggggagatctggaaagtttactattctactaatgttttgtacaagtgagaaagttgaaagagagagcgagaacccaaatgcagactgtcctgccatcatgtcatttaagtaatgtggcatcaatgtaagattcccttccaaggcccacttcatgtgagtaatgtttaatactagcattttccaaagcggcctggctgccagcagggtcacggccaagggtacatttgaacagtctgaagaaaaaaacaaaaacgaaaaccaaaaccaaaaccaaaacaaaaacaaaaacaaaaacaaacaaacaaaaaacctcttgatttttttcttcttctccctttaattttgttagaggaaatcaagtctgatacaccaaccagcaattggctcactgcaaagagtggcagaaagaagaggtgcccttacactaagcaccaaacgctggaattagaaaaagagttcttgttcaatatgtacctcacccgcgagcgccgcctagagatcagtaagagcgttaacctcaccgacaggcaggtcaagatttggtttcaaaaccgccgaatgaaactcaagaagatgagccgagagaaccggatccgagaactgaccgccaacctcacgttttcttaggtctgaggccggtctgaggccggtcagaggccaggattggagagggggcaccgcgttccagggcccagtgctggaggactgggaaagcggaaacaaaaccttcaccgctctttgtttgttgttttgttgtattttgttttcctgctagaatgtgactttggggtcattatgttcgtgctgcaagtgatctgtaatccctatgagtatatatatatatatatatatatatatataaaaacttagcacgtgtaatttattattttttcatcgtaatgcagggtaactattattgcgcattttcatttgggtcttaacttattggaactgtagagcatccatccatccatccatccagcaatgtgactttttcatgtctttcctaacacaaaaggtctatgtgtgtggttagtccatgaactcatggcattttgaatacatccagtactttaaaaatgacatatatatttaaaaaaaaaagattaagaaaacccacaagttggagggagggggacttaaaaagcacattacaatgtatcttttcacaaatgaatttagcagttgtccttggtgagatgggatattggcgatttatgccttgtagcctttcccttgtggtgcatctgtggtttggtagaagtacaacagcaacctgtcctttctgtgcatgttctggtcgcatgtataatgcaataaactctggaaatgagttcactccctctgctttctgaaatggaaatatgttatggtggaaatgaaagcctatggtgagattatcttctggttacactccctgtttggggcatttgggcaggggagtgatagactagtaggggaagggagatgggggagaaaagctggaggaggcctagggtgttggattttggcagtggttgggggagaggaattataagctagcttgagagtgaagttttcataattgggaggaaggggagtctcctctttcctttcccagtccccagtgatagtaacataattgcgctctcaatgggtgtgagctttcctctggcctgaacctggtaagtaagcctataccccaagccactttctcctcaaagcttcccatttgtgtgttttctcctctttggttttggttgtgttgtttttaatgctttcagtggcatcttggtgatttctggctggcgagcaatcatcaggggctaggttgaagctagtcttgcccacctggaagttgccggcctccattacaggagcaaggacaaacagcagtgtagcactgcagcggatccaattctgccccctttccctcagccctacccccatcccaagcgcaagacagccagaccccagagaagccgaggatgggtgagttttcccatcccacttcgccttgatctccttgtggacgggttttatgctcagtcattaccttttagtggcccacatgaaattttgttaaaggaagaaatgaaaagattttccccagtcagtctttcctctatttaattacaaaatgctggtgggaactgctgcatctgggatgcaagaaaatgcagaaagggtgactgaaaattttgcaaatgaacatgacttcccatgaagtctaatgttccattcgctgccatggtccaggggactcccaccagcttccaccggcttcaacaggatctccactagagagcccagacttatctagtcctgtcggggaaaagggagaagaggccttgcaggagaaagctaacagaaaattcgttacctgaggtcctgcctgcagtttcaaatagcttccagcagttttacaaaacacatcctttccatttcttccttttaaatgtttccctaagaacgatccatttaggtgctataagtcctcagccagggagtctctgggacactggcattcaaaattttaaacttccgccccaaaaccaggaacattccaagacagaactcttttagggggccatttcctgggggtgggggagagggcttggaatcaatgctagattgaaaacgttgtaatagctttgccccagacttaacaccggttgggcaggaggagggtaatttttatttagccgtttctccgatcatgtggggaataccattagctgttgatagcgggccatgtatccgaggaaagcctgagctacaaggcaaaggcatcccatctggaacaaaatcagaaagctattggcaaaggtaatcaatcaggccataaatagccatttacccgcttccttttcggggctggaggtgggccgggagccctccaagggtgagctgggcaacttgtagagcaaggaatatgccctccgctgccggcgccccggccgcttttgtctgggctcccagccgggcttccgaggctttgtaccatggatttgggagtgacaatgggcatttccctcagattcaaggctgctcaacctcacctctgtagggggaaaaaaatcagaagggagtgtcccaaggacctagccattcggccgaattttttagacattttgggagtctcctccgaggcctttaagtgcgaaccgcgcgaagcggccctgcccggggagactcgctgaggcagggctgaggcggcgggcgggagcaagctgctctagcatttgggttctgccctgtggcgtgttctcttccagggcctttccagcatcatcggagaagacgaagcaccctggccgccactgtccgtgctgcgccaactcgcccggccgcccgcccttccgagggcaggcagaagcccctctgtgtcctccaccgccgcgccccggctcgcccctcgggccgcggcgtgtgcccagcctcacgtcggggtgtgtgtggccgcgcgggcgtgtgtgagtgtggcagggggagggggccctccgatctgctccatccgtccgttttattagggacacattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcctgcctcgggcgacaccggcctggcgcccccgcggccgctccgtgtgccctggactcgccgcccgcggctcggaagctggagagtcagcgacggggcccgactgcgggaccgagggctgcaagaagaagcgaacaaatagtccccagcgcctcctctggatgcggtcgcgtctgtggtcctggcagccgctgggcgggccaggccaggtcgggccgggccgagccgggcacatggacctgggcctgcgggctctaattgcggcgcttatgttgatgattttttttttaatcacagcagcccccagtttagcggactgatttactcccggtattggtaaatatgatcacgtgggccgcgcgaccaatggtggaggctgcagcctgcgaactagtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctcgtggtccgcggtgccctcccagcccccggcagcggcggcgatgagcggcctctaccacccgtacgttcccccgccgcccctggccgcctctgcctccgagcccggccgctacgtgcgctcctggatggagccgctgcccggcttcccgggcggtgcgggcggtggcggtggtggtggaggcggcggtccgggccgcggtcccagccctggccccagcggcccagccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcagcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaagtaagtgcaaaagaaattgccccctgatttattgctgaaacctgtaaggctcgaatgtgcaaaactgatagttttactaacctataaaaacgtctagacgcctacccaagcctaggcgaacaacatgcatccataaaaagagcttcccataaccacctaccctgggcgctcagttagtacggtaaacagagcgcgagcattaaggctttttatgataattccccacaagttgtgaaaagcgaccatccttggtgaaattaatttaacgacctctcttccccaccctgtggtctctccctgcctcccctcctctcctctctccccgtctccaaacctccctctttgtagacaaccccgccgcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttctttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcgccccaattccaagaatgaaggcagagcgacaacagtgcggacaccccggctgctagcccacggtgaagcccggcggggttgcccaccagttgcgaaagccccctttcctcagggagcacgcgggacctcggtggagatctccagtgaggcttagaggagcccagggcctcgggcgggttggggtttgtcctcagtgcattggacgcgctgctctctcccctgaaggctgggctcgcgtgggcggccgcgggtggtggccctcccggttcctgcccgaggaccagttgtaaatgttactgcttcctactaataaatgctgacctgatcaaatggagcccagacgctggccctaaacattgtgtgcctgctttctctgcctctctgcaaaatatcacactcaggatatttctcctctacccctgggagtgagacattgttaaaaattcagggcccttccacctgacagatctctctgatgtgtctctgccttctctgcctcacatccctttgtgtaggcagatgcagcagcacagaccctgtggggggacattggtgcctccccaagcctggttcaaggtcctccacgaactctgtgcttgggcccagtgttagccttgcagaagcgcccagaagagccagcaggccccagaagccaggcactttcaggctggggcttgggtacacagcaccctaaccttccctgggctcctgaagccccagatgccaaacccctctccaaacaagggaaaggccaactctacactctggagcaactgtcccagctcggtggggctagctggctccgggaggtccca

SEQ ID NO: 464 - DNA, 8000 bp, Homo sapiens
  Locus number 76 genomic DNA region, spectrin beta chain, brain 1, spectrin, non-erythroid beta chain 1, beta-II spectrin, fodrin beta chain
caggttcctcatttgtggattcagctgacaacagaacgaaaatatttgaaaaaaaaattaacaatacaatagaatacaaataagatgcaatatagcagctgtttacacaatatttacattgtattagttatgaataatctagagatgatctaaagtatacaggaagatgtatgttggttataggcaaatactatataccatgctatataagggacttgagcataaggagtttggtttctgagggaggtcctggaacaaattccccgtagatactgggattagatacggaaggacgactgtgcctgggacatagtaagtgctcagtgaatgctataattatattttaataaaaaagaaaaaaagtcattttctttccatacaactattaaacaaccttctgccacacacacataatttcctcatattctgggatttttaaatagctggcccaggtgttgaagaagggattttttgaaagagaagtgatttacataacttctaaatcttgttcagtcctgagattttacgattccatgaccctctggtaagtttcttttttttttttttttttgagacagagtttcgctcttgttgccaaggctggagtgcaatggcacaatctcggctcactgcaacctttttctcctgggttcaagtgattctcctgcctcagcctcacaagtagctgggattagaggcatgtgccaccacacctggctaattttgtatttttagtagagacagagtttcaccatgttggtcaggctggtctcaaactcctgacctcaggagatccacctctcagcctcccaaagtgctgggattacaggcatgagccactgcacctggccaatttcttaaatgatttgaattagtgagactatttctttgctggagaaaagacggaactaatttagagcagttacaacactctgggcactttgatgtgcactttacctcctcttgtttggtgctgggcagtctttagatgagtccttataatacgtaagcttagtaaactgcgggagggtgggggcaaatatagctgagagatacccccagagggcaggggcacagaagtgcttgttccttggaggcaccacttaccaagtttggggcagggctggttgggaacctactgaaaggtttagctgcgtcagcttcttggggaggacttgataacagcgatacaaggcccagaaaaggtaaacggagaatggaaatggtgtgaggcacagaagtgcccacctcacatcgcccagacccagcccgccccagctccatgctgctggtgctgctgctcctctgccttgcaaagggcgtgcccttggtggcgtgagtgggcctgaaggccggccatttctgctgccttcgagctgacctgcaggtcatcaaagagaatgatgaaagaatagcaacccaccttggaggggtgctctctggggagtgtcttccaagatttctcaacctagcaccgctgatattttgggccagataattgtttgttatgggagccatcctgtgtaccgcaggatgttaagcagcatcctgggcctctaccctctaaatgccagtagcatctacccatgaatcgtgaccatcaacactgtatgtagacattgccaaactgctaaatgtgccgaggaatcaaaattgcccctgctggagaaccttgggtctaaataaccaaaccagtatggagcttgtaagtgctacctttttgtacctttttgtaccttttgtaccgtggttgtaagaagcaaccacggttgcttcatgctcataggcctggaagtcggctcactgccctctgctgccccaacacctcctcacgcagctagccccagtcacagcagcttgagcttggaagcactcctggattgcctttcatcgtcagtgccaagggcctcctgctcctcctcagactgtctggcccatatccccaagccttgctgggtggggagtgcaggggtgatgtcattgtgccttcccaggataggtggaacaaaggagggagtccccaaggacccgaagcctgatcctctactgagccaccaaatagatttcttttcccctctgtctccctccttccaacttcataagcatttgctgttctccaagtgctccattgtaagaggacacgctagttgactggggctttgtgtgtctctgttgagtccgtttcctgcccctcgtgtgttatgagggtgttgattctggtctggtccccggatggaatcttctgtgtcttttccaacgtgggggtgtgaacctgaggaacttagaccctgcgtgatttttccagcactcttgcacttcgtggggcctgctcctgactgtgaggagagttcgaagggaggggaacaggaagagagggcaggaacacaagagcttgtttttttatttttgacatctcttcctcctcttctttcctcccacctactttgagtttctaagaaccatgatagccctggggagccctcccggcacagatctcagtctgtttcagctctgttctctgcacccacccatgacctctccatttgcctctctgtagggaggagggttgggattgggctgtaactctttaggacagggcactaaggaagtatattgactgttgtttctggcaaatcctcagagtttccttgtgaaagaacctgttaattcaaaacctgaaagaagtctgggtgctcctttagtgagagattcacccaaaagagtgacaattggctgaggaacacattttgtgcttgtttatttagaaatattttaatccaagcaggttttcattttgatcttgctcccttgcttcattaaagacattttctgactccagtataacgcataaaggattttataattcacaaaaaaaattgttaaccctaaatacatataaactatgagttacttgcctccttgataagaggccatctgtgaaatgcaccttacatattctgctctagacctgctctttcagaatggccaagcttagccccagaattacagctcctgagtcactgtagtaaagttgccatccatcacaatgattacgtgatcaataatgcatgtggtcttttctgtgggacctgtcatgatgttattggtgcagctgcttctccactgcagcctgccccttactgtctttttctgcttcctctaatcctgtcctttttgatcctgtgtttctggttggcctttgtccctggggaagggccctccttctgtctggatgggtaggtcctttttgggaaaggcaggacctcaaggagccgctgactgtagcaggtggccggggatcttggcaggtgccccagctgattctcctgccaggtcggcagctgtaaaacctcaaccaatgtcatctctgcctcattccctccctgtggtgggtggtggagtgagtttagcaaagccttcagacagaccttcccagggtgttgggctgtttgctgtccttctggccaacctgagaacccagtactctcaggcgactgggcacatgccttattagcaagggtggctttttagttgttacccccacccagtggttttgaaatacatgccaaattgttgagctatctgctttttttttttttttttttttttgtagattcgtgtgtaattatttttgtcatttgggtttgcactaggagtaggtcttagatttttggcataaattcatgctggtggaactagatatagtgtatgtaacatagagaacagagtcagggagtaagagtggttgggtccagggtacgttctgtggatgtctgttgaaggtcttcagcaacctatgtttagaacattctgcagaggcaagaagtttgaaagcctatttgtatggtatgtgaaggccagttctgggcaaatatgtctagagttttataccttaaattggacagaatttgattactgagctttgaaaaacctttaacactgtttcctggatgacttgaatgtacaacaatcacgctttagaccataaatcagcagttgccttttcagcgaaggatcacagtatggagattatatttttcttctccttttatagaagagaacattgaatcctgtgttgagtcacatttttgttgaaaccttgggcccagaccctgctttcccgatgcctgcaaagacttcccgatgcctgcgatgtctttgcactctaccatgttgcttgccattttcttttgttgttcatggtgtgtgtgactgagcaggtgaagacggtcattgccaaggtcatgagttaatttatcttgtccagtgttgcccaatcctttgtagatgagggaagcagttttctgctgtctcatgagatttcctaccctacaccctttaatatactcaccttttggaggaataatagctgtaacatgtatgtaggaagctttaccagtcaagtattatggtatagggcaggactgcaaaggaccctgttgtcatctgcatcctgctgcctcttcagcagggatgggagaaaagaaaggggagcaaaggatgttctgctggcagtgtgcctgggagctcacatgtttaaggactggacagttcctacacagatgctccttgacttatgagattatatcccagtaaacccatcgtaaagtcaaaaaattgtaagttgaaccatcagtaatcagtgttctttctcaaagacatgaccgcagttaaggggcgctaagtagaggtgtccttggaggtcagttttgctgaccttcctctggctggggtcttgtggccctgctagcatgtgcctgctcctgccagttctgtggtcaatggtaaaacaagttcttctctgcttgcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctggtgagtggagaccttaggaagtgccgtgtgttgtaggtggaaaatatttttgaaaaatcaagtgtgacttgtctcctgttgaattctgcacttaatggttgatagttttgaggagaatcttgagaagtgagttgagcgcttcagggagagccttagtgtcacattctgagcgtggatgatgttcttgagctgtaataaagccactttgttctggtaatttgcaaggttgccacctttggtcagaaagaacttggctggggttcctgccaagaacagggcatggtgctggaatttgaagggccaggcttgggcgctggcttctagatgaacctgtgtcccacatgcgatgatggaatgttttctaaatttgtgtctttctggttgtctagaaaatctgagctgccatcttaaggtggcaagcattgaattcagtggccactgatgttttcttccctgcacgctttttattttgggagtggagggagaagctggtgttttgtcatctccttgggaaaggagcttctgatgaattcaccctgccttttcaggcaggaaagttgtcagcctgcaatgaaaattgtatccccaatctgtttcccagagctgctgcggccctctctgatgtgactcttgtttatgcaccttataccaaagaagcttaaagcagtcactgtgactgatccaacaggttttgtctcaccttggtttgaaaatggttgctgtatcctcccagagcacatgtagtgccataggtggaagtggtgccgagccagaagccaacgcccagaatggagaccacatctgtactgacatcaccaggaaaatatgatgctggcagttggcagggctgccagaaagccttatttttaacttgatctccaccctgtagcttgccagccgcagtaggcctgtgtgcagacctgccccacacctctgaccgcaggcaagggtctaaggttgtcccttgtcctatttgttatcagctcagagacagactgcctctttgagtctgggttgaaatggagccagaaaagtattctcttccctgcccttcagttcaagaacagggctctccagaagatagtgaagccctgtcttctctgtagtgagtttcatccatgccctttgttcctgagcatgtaggtcttgtggcctcattttctgtgagggtttgtcggtcacactagacaaactagacaaataacggagacccctgctcaaaaccatgatggctataagaaggcagttgatttgtggtctgggggtgagggagtggacccacatggggagtttgaacaggccatttattgcattttgatttgattttccaaagtgagtcttgtttgagagcctagactagaattattgtgatatgcagctttaagtataatttttataaccagacttcctttgtctacctctcaacctttttttgtttcttagtgtttaacctagtatgtttatttattgattttttttttttttttgtggagtgggggaatggtgttttgaaagtagctaaaaaaaatcattaaaggtcacatggataggagttagtctgaacatttatttttgtggttttttttttttaatttatttttgttccaatagggtccaatcttctaggctgtagggagtaaactgttcacctttaaagacccataattattttataccaagaagattgtgtccttgataatgtccacatcataaatgggatcaggcccattgccgttttttctgaacagggcaagaaaaatataagtagggagaaaaaccagtaaagcataattcttagatgtgtgtgagtatctcccactcctctccttatttgttagcagtaagtttttttgtggcaacccagagacctaggagagtaaggatgaagaagatggtacagtggctaccatctccaacctcttaggcagtcgatatcagtagttttacagaactttgtaaagcccctagtgccttcatttgtattacccattcttcacagccatcttggattatataggttggccagtctaattttcttattccaaaaataaagataccatagatagagtgctcttaaagctcttgttcatctgggctggagattttaagtctctttggcctcgtagtctgtttggttcatggaacttcctggaaaggaaacacaccacacactgcctttggccgtggaggttgccaggacctcaagttaaagatcctccctgcagaagacctccatgagagcttgccccaaaggttccttgcatattcagattccagaactaatgaggtggttagagcttccaggcctgggtaaatgaatgtcccagctaagtgtgtcatcagataacattagctgggctttctgcaccagtggtccaaaaccctgggtaacataaatgtttgcactctatctggagcccagtctttgtcagccagcattttagccccagcacttaaccaccagcttggcaatagctagcagataaatgtttgagggactaggtgattcaatttacttaattaatagattcttagagccacttcctttacagaggaggaaatctgtgaatgtgtgcatgtgtgttttctgagtaaagttcaaagaaacattaatgacccagacaattccaccctcaccccaccctggattttggctcaataatatttgagttaaatatgagcaagtatcatgtaggcatttgggaacttgattttgaactactcagcaacatcacaaggcagagatctctggtcctggcctggttatgatctgtgtccagaagtgtctgctccctctcggtctcaggtgtatcagctcatagagcagtgagaaggctgagagctgggccaggaagcttctgctagtcaggattagattgattagaaataaaactattcttttctcatttcttattctgagttcactatagtctataactctccataaaggtctcacttgaaaaatgccttagaaatacagacccaccctttactttaacattggattggcagataaaagtgtgagcacagaacctgt

SEQ ID NO: 465 - DNA, 8000 bp, Homo sapiens
  Locus number 77 genomic DNA region, kin of IRRE-like protein 3 precursor, kin of irregular chiasm-like protein 3, nephrin-like 2
gatgagcacagggtgcagggagagggtgtctgtgtaatttaggtagatggaaggcaggatctctttgtggaggtgacacatacactgagatgtatttttactgtgagctccttgagggcagaaaatgtgtcttactctacttttttttttttagatggagtctcactctgtcactcaggctggggtgcagtggcaggatcttggctcactgcagcctctgcctcctgtgttcaagcgattctcctgcctcagcttcctgagtagctggggctacaggtgcgcaccaccaaccctggctgattattattatttttttttgtatttttagtagagacagggtttcaccatgttggccaggctggtcttgaactcctgacctcaagtgatctgcctgccttggcctctcagagtgctgggattacaggcatgagccatcgtgcctggcttgtgtcttatttttatagctccagtgcttagaacaattctggcacttgtaagaaattggtattatttttatggtattcaatgactgtttgatgaataactgaatgatcactcatcagcagttcctatataaagcacatgtgcttaatcacatgaagacaatgatctcaaacaaatgtgatattgttatggctagtctgtctttacttcctcctttcttgcctgccctttgttgatttctgtttgtatctccttttgatggctcaattgtgttgggtccacacagtagaggacacacacgcacacacacacatacactctccatatattaccaaccacctccattcctgcaaagactgcagattctatccacgaagctattaagcactcccaaatagagcaaacctctcattgactatcacgtgcctccttaaatgatctttgaatagcattttctttttattgctttgtgtagtttaacggcaccaattgcaattactctaacttatgataaaccccagatctataaagctcctgttcattcattattttcctcttgctccttctcaagctgttattttttggaatgtagtgaggagggaggagtggagagagaagaaaataaaaggacaccaaattaacaggaaaacaaataaaatagggaagcacttctccctgggtgacaggcaccttattagatactgttaaacagaacaaatatgctttaatacagcacaagtaggtcttttatatttattctaaatgggaaatacaatgatcatcaacttatctttaagggaagaagaagctaattgttctaatatctcactaatcctagcaactgggagaaaaataattgtttttccctattttaccaattgttcaatttataccaaggtgtgttgtgtagcatggacagagatttctatttcttgatgtatgtcatggctgctattccattttaattattaatatgtggaaattataattattttgagtattggtatgagataattataaatataaaacagctccgcatgctttctgatgcctttcttatctgcagacatgttggagtttgggcgtatgagctttagagagagagaaatgtataatgtggtacttagggcagcaaggctggctggagtggaagaagaggagcttcctccctccagagccctccctctccttcacctctgccttccagctctccagagccaaagctgacccacctgtgtctctcctctgccccactgcctcaccctcctcttaccctgtctctgagttgttagttgagatttctaactcatcacacatgttggctcagcttgcatcccatcccctcatctcctcagccacccagaagctgaggtcagatatctggagctatgggtttcaattccagcccagctcctgactttttggcttccccaatccctacaaacctctttcgagcttctctaatgagcatcgccagcaagagaacatgtctattcagcaccacggacagaggcacgctgtcagttcccacaaattagaagttactgcctagcagtcttgtcaaggcagtggtgttggggagggaaggggaggctgagaaagagaaaagtcagtaaaggcaactgactagcaggacacagaaaatgcggcccccaactctggttgtactcagccatggggttcctacaaatgggaagtagctttttgatgctgttggcttcaggcaggcagcaaatgggggaggtgatcacttcctgtgcttaattgtgctggcctaactcttgtcagattgtcaccatgatgggtgctggaaacaggtccacagctggcaaagtctcaggcatggggagcgcatggggatgtggttgtcgtggtcggggttgggaggagagacagctgaggagcttggaaagagggcactgagaccatgctatggggatagagatggtagaaagaagcttcctccttcttgctggaatgggaatgaggagacatgggccctgggccctggaaggggaggggtccagcccatggcaagcatggctggtgggagccaaggcttcatttgtctgactttaatgaataaatggcatccccagccattgtttatctacttttgaatcctgacaaatagtctgtggcatctgatggagagggttattagctgcatggagacagatggctagggatggagaggattggttctttattacagcagacccgtaagtgacagcactcctcctcccagcctctatgccaatgtcaacacgtttctcaagccttcagtgacccaatgaagccagtgcaagaggaagacagaatggcctctgagtaagagggaggggtagggtcagtggagttgggaaagggggcaggtttcctagggtaagttctttgggaataaagacattgccatattcttctttggtattctcctaagtgcctgtatagtgctgtttattcaacaggcattcaagaaacatgagtgatggaggaggcaagtagagaggtctggattagaaatgaaaataggagcagatttaattgggctggctgtggggtggggtgcggaagaaatggtagggaagagagaggaagagaagtaggagacacaaagggagaagggaagattgcataaagaaaatgcccctgaatcagcatcctgtgtttcaggcattcactatgcttccccatgtgattgtacaaatggcttcatggaaaccaaactggtcttcccactgtccccttctgagaggtcccaggttcttattcctggttcctctgtcctgtggctgtaggggagagcttcctccctccagattactcccgagacaatggggaggttctcactgaccttcattcattctccgaaacttgtccttggccatgtagcccagcaccagacagcatcctctcttctggaggcccagctctggaagagaagcataggtgggtgagttgggaatgggaacaggtcaggcattgttggggggccctctgcagggggctgtggagcttgttgctcttataaacagaggtgcttttgtttagccaacatttatatggaaattgttatgttccaggcataagtttaagccagcaattcttcattttgattctcataacaaccctgtgaaggatgtttccccattttctatcatccccatttatagatatatgaagttagtggcactggatgaaagagctagcaggtggtaaagccagagctttgaacctaggcagtctggctctgagtccatgctcataaacataactctgggttattgaggccctttgtatctcaggcttggggactatgctcagatcaacttgggactgtggccagacctgccagggatgatgcagaatctatccagtcgtgtctaggatggaacagtgcaaccagacatggtgggtgactcaggaggatgaagtgattgcgtgagtttagggcagcggggcgacacagaggttaaggtataggcagaagagctctctctaccttttggagagggtgcgtttctggtgctagagattcctgtgccttcctatatcaaggcccaatttagcaccatcatcaagcacttatgaaatgtagacttagagcacaggggtcgagatagctgagagacacggactccacagggctttgacccagttggaaaaacaagatggaataacaattccaggtagcaaatgcaagagataacttttttatttgcacagtattttgtaaatcagtgtccattgtgtgtgtgagcattaaattggagtccatctgcctcacaagaaggcaagctttcctctctggtatttgtgctttatcctgattcatcttaatcactttatggatcctgaagcaatagcacactaatttttttgacccccctctacccccaaacaactcactgaggtgggcatatgggccactgcaactgacattatgcagatgggaaaattgaggttcaaccatgttaaatgacttcccacgattgtcttagacccccaccccaccttgtagcatagaagtcttacaaatgtgtcagctgccacaaacttggtaaatagataaggaatttgatttctggaagagggaatatgactgcagctcttcctggcccttgccagggtttctgggctcctccctgctccttcctttgatttctcagagaaagagggtcccaatgagtgatgcatcacagcaccttctcccacgacaccgactgcctccctgaacccagccagtcagtgtctaggctcaagaggatagacggagcgggtcattcctctttctcctcttccatccaccgtctgcagcccaggtccacccaccaagcatagcaggatgaaagagagtgcagggcccatgagacacagataagtcaagctcaggggctcttgccctagagaaaaacaaaacatggcaggaggtggcagaacgccacggcccagggaggtccctggctttgatctcctgattctttaaaggggtttattgactatcagtaaagagcagagaagcagatctgagggcactgtttccaaaggcactcacttctcttccttcccctccacactggcgtctgaaggcttagccaaaccgccctcacttcaaacggtcttacatctcaggcacccaaattgacgatgttaagttccctcattcaaggccttggccctttcttcaggggctcctgctctgtcgcaggcctcatggatcaaagcccctttgatgtttacttactgtatttgtggattctttctaacaaccaccttcaagaggcaggaatgcagccttccaggagggggccagtggaagtacaagctgcgaggaggtgctgagctccctggaacaatagcctctcgagggagactgtattgaaacctcaacacgctgacgacaggcagagttaaccagcccattgtaattgcacacgcattgttcatcattagaatgatacaattgctgacaattcctattatatttttgccattgacttcgtatgcccatctaaagcacatcagcaatggctcctaatgagaaagggagtttgggctcctggactaagcccaaactcaatccaggagcttgggagggaggcaggggagcactgagtagggagggcagaagatactggatggatttaggccaatgttccagctggtcttctggactgtgactgaacgctcaggcaaatggaagggcgaacaattctcttacagatttagagagtgtgagcaatctgttgactctggattgtcttagttggatagagaactcaacctctcctatgccacatactaggacaccccccagggcaactgcttgaggagaggctgtgtggacaagtggttatgatataataactaagagtctcactgattatgtttgatttttgcaaatgagcaggaaaagaagttttaaaaaacctgattaataaaagaaattgagaatgaggcaatttctcaatgtatttggctcatttaatttgacacgcgtgggttagtcttaattatttaggcggctacgttacaaggcgctaataagcacactgcagaaatttattaagtgcgagggctctctgactgagactttgtagagaagtggggagaagctactgggatctttgcaagaacgagcaggttggaggatgagtgaagtgagaattagttaattgtccatatatgaaaatttgggatgtcctttggagagatttgcaaagctaaattaaaggtcattgggttcacatgagtgtgccagcagggagtgaagtgggggaagggaggggatgctggaaacccaagtggggaggtgaatattgtccaagctactaaccacagagagaaccaggaggaagcaggaggcaattgctttggcttggggagactctaccaagccaaactaactaggttattaggagagagatgatagaacatgacagaaagaacaggaatctctctctttgtgaggtagatcagccaccaccagactgtcaccttccttgtcccatagcatggagatgaatgggagagtcagatcacagatgcacattttggaacagtaagatgatgggatcttctccaagtaggctttgggggtgctgtctttggctttatcagtagcagaaacacccagatactctaaagctggctatggaaaaataattaccatgaaaggagtcagccctggcttaaaaggaaagttcatagcaaggaagtccagggtcacctgcagatggggcagtggagggcactgtcccaggaacaaggaaggtttaggaataccacctgtgcaaggaaaaatggattggagtagggtatgtttcttagggagaagataagtttgcacccttgggaactcctggcctctggactctgagcaactgaagtgtcaggactgtgccttctcctgctctgagcccgtaggaccaagcacagtgcctgacacatggtaagtgctcaggaacagtctgctgacttaatgaaagggctggctacaaaatatgggactgtgaagggttccttctgactcgggtcagaatgaaaataagtgggcttcactgtagcacaatgggtttaggttagcagaggttggttgtagagtgaatgaaacttgtagctcattggaagagaagcctagataacatagtgggatttcctcctgggagaaataaaaggggatggctttttaaatgggatgggttttcttccatttcagagggtgcagatgggatgttttctagccttagaattccttcattcttactagtaatgtagtgatacggtggtattatttcatatttgtgggatacttattttttaatgacgctgtcatattccctttctctttagatgctcacagtaagtagctctgtgacacaggcaagtcagaaattatctatttcattttggtttcacaaactgaggctcagaagtaaagtgacaatttaaggccaacacactagctggtgatagtgcccatgctggaacccatggctgatttttggcttggttcttagggtaaagtacggggtcgcagagctgcagatgctgcaaatcaagacagaccagagactagagcacagatcagcggtgtgggctgggacagtgctataggtcgaattcctcaccaattctgtgttcccctcctgcaccaaattcgtacattgaagtcctaatcccagtccctcagagtgtgaccttgtttggagataggaaatttgtagaggtgatcatgttataatgaggtcattaggacggacctttatcctgtgactggtgtccttatgaagaggaaaatctagtgatagacacatatacagggagacgctgtaaaaacttgaagacagccatctgcaatccaaagagggtgcctgggacagatccttccctcccagccctcagaaggaaccaactctactgactttggacctccagtctccagaactgtgggacaatacatttctgttgtttaagccccacagctggtggtactttgtaacagcagccctagcaaatgaatatagacaggacagggaggagtgggtcttctctga

SEQ ID NO: 466 - DNA, 8000 bp, Homo sapiens
  Locus number 78 genomic DNA region, cDNA clone CS0DF012YF04, fragment
cattgaacatattttctttgttctgtttacttgaaaagtaatatagcctagtaatgtatgtaaaagcaagatctgtacaccttaaaaattataaagagaaaggcataaatatcaaaagcaagtgttatcctttagaaaattttaatgaagatattgtcttcaaacttatatatacacactatcccaaaaccaaacagtagttgaaggaagaaaggggggtgagggggaaaggatacaacttccctgctgtagtaccatgcatctgtcttttcacctttcacggcagggaggctgaacaatcctctttcatttcatttcttcctagtcttttcattgttaaaagtatgagaaaaattccagctcatgagaatattatttcactaaagatcagcaaagaatgaggagctttcatgataaattctctgaggtgatgttcagtcttatctcgcctaagtctgcaatgggagaaatgcagctctggctgtaactatgtatcaatctattcttcaatgatacccccaggctttctcactgcactaatcataactactaaattcactccaactcttctggaagtacagttctgcagcttgaaatcaaacaggagctttccatataaaatgaaattctaattaaaatagtattttaagaaaaatactgttattatgatagtttcatctttgtttgaattgttcctttgattaagaaacaaacatttgtttcaataagaaaatgaaaagaaatcagcactgccagtaaatgtggccttcaatcctgttacatttactcccgactggcttttgagaatttattttccaacattttggttttaatagtatataactgagaacctccaactcaacagaaaaatgcataactaaaatagtgtaatacttttgtcatgacagaaaaagaaacaataaaagcagttatttcaaagtagtaagtcatgcagacactattacacatgcagagtttatggacccatttaacaaaattaatatgcttctatatcccagtatcttaatgactgtttagctaaccagatacttaaaccatatatttaaatgcttatgcacctatattacatataccatgctgcatatggttcaaatatgtatgttctttacagaaactgaaagctgaacaaatagtagtatttctaagtttttgattactcataattgggatttacatgcgatctataaacactgaaggaaagccagaaccactacattttgcttagattacattatgaatcaaataaagggttctttctgtcttggggtgtgcaagagtgaggaatttaggggttgatagaattaagatatatatttttttttccgtaagtcaagatgcagtaattttcttcttctaacattctactactaagtaaaataaacatatacagtttcaaaagcaggagccgtaagcccaagtcaagagatgatatttcagaaaagatattcaaatgaagctcaataacattttttccaacaaagaaaatttcaaggcagatacagccagatctgttgcacaagtggcaaagcaaaatattttagtaatgggctgtagggggatttaatggactgacactctgaatatttaagagtaatattcctttgaagagaattgcatgatcgtctatcaagctccttaaaaggggtgagggaaggaaaggtttggagggtggattatgtccaagcatctcagctattgctagtggtgaaaagatatgacctgggtagaatgggaaaggttttgatgacatgagaggatctgcaagagtctattggccctatcatgtttattctcttttaggtacacatttcaaaaacatatcctttccaacaggctctcgtttgcagtcgcggcttcacagacaacaaccagcttgcattcaactgtggtccaatgcatcagtctagttttaagaggaaaacaatggacaggaaaaataaagttgcagtcttatcaatgaaattcttattctcagttggagaatagggaaaagggaggctccaaaacagggtgatgggaggggaataataactctttaggtgagttttgggaaaatgctaagtaaaatgctgttcagaaattgggattaatcgagcagtttaaatacaaatctgccggaaattggaaatcgtgctctgtgcgaatgaaaatgaaagactttatgcatattctaattttctctctttggctgctattttagaggaagagacttcttttgctgatggtgggacttttttgttctgcacaggaaatgtgtaaatgaacacaaatgttttttcttttgcctttccattcctctcttccattctcccctccccctttcaacaatctgaagttgttagggtccgcagttctgccgccaccgatcccagtgttacttcccattcccaggatgttagagggcaggcaatgtaggcaggacaggacagttagggctcctccggaaattagacctttggaaatcaatgcagagtttctattacatttctggacattcagagagctagaggatgagaaagactcttggttgaatatgatgaaaaatcatctagatgaaaaatcgtctagaaagtcatttcctctcaaaccgaattctcagtgacagctaggtggaagagagcttaaaagtgattttataaaccacgctgtgaaaacctactgacgatcagtcccctgtccaaacacttttcctcccactcctttgggaacatacagggatggtgcattttaattacattaaaaccagcaagaaactcttgttttattctgatgtaaatcagtcacctaatgctgagaaggactgaagtggctcatatggtcgttctgtgttttgtagaatacgtaggggactcctgaaatgtgtgggatgtaggtaggggcgggagcgactctgtggggagagaagggagaaaaagattgagagaaggaaagagaagtgtatttgcaaggcaggctgacaatttctcaattaatttggggcagagacagaaagactccgagtttctagcttcttttctatacctcagataaaaaactgaagacagccttattctaacaactcaatttaaaaagagcccccctgcgtacgtccccgcacccctttcgccccagcggccgctcacaaagcgccacccgcgcctcgggcgcccgcagaagccggagccagttctcagccctgatcgccgccagccgcccaggcttcggggaaggagggaggggagaataatgcgcccctctttcaataaacgccactgccaaccactccaacagacacactttcggtcccccgccagagctccggtgcccccgagtgaccgctttctgcgatcgcgtccgccgggaccccgtccctctttccccttcagtcttcagggagggggaggcgctccgcattagcggggcagttcagcaaccccgaccccacccgcgtggctccaggcccaggggtccgttcacttccccgtccggtttgggggacgccaattcgcctaagaaaaccctggcagaagagcgcggacccttcactacaaacctcacgtcagggttacagccacatttaggaacctcttcggaaaagctgagaaatcactgttttgcaaaaagccttctgtactgtgatggggctttgtggtgagaggaacctctgagaagcctcgtgcggcttgagtttagagtcacgccctgcccagcgacattctcccgcgcacgggagaacctgcacttccggtctccaaccctcgcgggccgtgactcttcccctcccccgcgccgggccctgcatttccggcccccttgctctcctgcacttccgcccagtcacatggatgatggatagcgttgggagctgttttctctatcttccaggtggctgctgggatcctaaacttgtttctttaatttctctttaaaaattgaatgtcctttagtttttttcacttccttaaatttgagggtcgagaaagctagaggtggagacaaaaggctcattgaagacaaatcttttttggcttttcagatcacttacccctttctgaattccctgtacaaattcataccagtaactgagatttaggcctccagggcctaggccagtgtctgcacttagtaggcacgcaatacatgttgaaagaattactggataaatgatattctgtctttaggcatatcatgcctagggttaatgggtatcttcaaatcaggtgacttctgtttttggctgaatttagttgaaaagttgataaatacatggtttttacaggcacttaagtgttatttatttagggactccccaaaacaggtgtgggggaaaatcaccacaaattgttggaaaaatatatatatagggtttttttgttgttttttgtttgtttgtttgttttttctgatacatggtcttgccctgttgcccaggctggaattcagtggcgtgatctcagctcactgcaacctctgcctatccggctcaagcagttctcctgcctcagcctcccaagtagctgggattacaggcgcccgccaccatgcccagctaattttttgtcagaggggttctcaccatgttgcccaggctggtctggaattcctgacctcgggtgatacgcccactggacctcccaacgttttgggattacaggcctgagccaccgcacctgtgctgaaaatattttcttggacttctttctacatatgaggtaaagtgctgtgatttttaggtttttgagttttatcaactctcacccaggctggagtgcagtggtgccatcttggcatactgcaaccaacctccgcctcccgggttcaagcgattctcctgcctcagcctcctgagtagctgggattatatgtgtgcacaaccacgcctggctgatttttgtgtttttggtaaaaacgggcttttgccattttggccgggctggttttgaactcctgacctcaagtgatcctcccgcctcagcctcccaaactgctgagattgcaggcatgagccactgtgcccagcattttgctttcttttaaaacagctttatttgataagaggtcaagaccttatgaaatgaatttaaattcttgtagtgaatttgaggcagaaacgacgactcctcttttatttttcctgctgctgtattatagtttaattcacttccgtgttgtcttctgcctcattcggcagttcttgttctctataataacttttatgtttaaatgccaaaagaattttttttgtaaccagttaagagttgtgaagttgtgagactgaattcagttgctcatcatgttttaaatgcatatctactcagcactggttgtgtaatccacagtctgttccctagagcatttaatgacccacgttcattgactgtaaaatactcaaaatatataaccagtgagctagtaatcatgacagtgatttgaaatgttatagttgcaagtcaatataaagcatatttattagcatcattattaagaggtgtcagagggatacaaataagacctgctcctaccctctgggaacttacaatctggttgggcaaaataatgaaatgtaaattgatagaaacagctactaacccatattcggtgtctggcatattgaaggcattcagtaaataattacctcacaataattgcagtcctgtcattcttatagtagaatatgatattgataagaagtaaaggaaggaataattagtaaaactttaggaaatgaatttgtcctgtatatgtcacacgtggagattggaatatgcaagttgattgtgtgtaagaagaataaagggggcataaataaagatgagaaagacgtttgatgagatggagtttggtggtaaattgaaggaaaacttaaagaccattcagaggagtttctatttgatagtagaggtaataaagacccatggtggccctacgagcagaggatgacattactaaaattgagttttattttaaaaatgattctaggctgggcgctgtggctcatgcctgtaatcccagcaatttgggagtccgaggtgggcggatcacctaaggttaggagttcgagaccagcctggccaacatggcgaaaccctgtctctactaaacatacaaaaattagccaggtgcggtggcatgagcctgtaatcccagctacccaggaggctgaggcaggagaatagctggaaccggggaggcagcggctaccagtgtatctgagattgtgccactgacctccagcctgggcgacagagcaagactgtctcaataagataaataaataaataaataaagattctagccagcaactgaatatagggaaaattgcaggagaaaagattagtgcagttctggaatgtggtactgttagagaatggctatagtcagagctatcattacgtcccttctcctcaatttttatacaattgaaattgcattgaaatgatgaaatcaggaatgaatcttgcatagaacaaaagccagagtaccactggaatcagtactacccccttattcttcattattgatagtgacaggggatgttagacattgagagaaggcaactaaccccaaaatattttcatcaccagttaagctctagatattttttttttttttttgcatttagcatatccacccattatgcaattgcagtggttctcaactggggtgatttttgtccctttcctcccctgggagacttttcacaatgtctggagacattttttagttacagcacctctggggccactactgacgtctggtagatagatgaccagtgtattgctgaacatgttaaattcacaggatggacccccataaccacagactactatgtccaaaatgtcagtcattctgagcttggaaaaccctcagttatgggaatgaagcatgagctccaactctggagagctgcaccatgagtcccaggtcttaacttctattatggcaacaatttcaatcgaagaaatgttttgcttagtgagacaaatataactgaatatcccagtaactttgcctacccctgaggccttagagacaagaaaatcagaagggtacctgcttggattttctactttttataaaataaagttagaaatcttcttaaggatttgtcttcatctaaatgttatttattaaattaataaaatgtgcctttggagttgcttagcaacttatggaaagcttgctttttagaagttcatttgtttgtttaaaacctggataggttgcatattattagccacattacataaatcaacaaagaaatgtacactgaaaatggaataagatgtttcaacacattttcttctctcctgtctggcaattaaaacactctaattgtctggtagaattgcatcaagtattcgacaaacattatttatgtatgaaacttcaacataatattgagtatgtaagagaaccaaaggggaaaaattaaacaggtttgtcataaagtatgtgtttatcttaacctttcttcttcaaaaaccttatctactaagtagttttatcagacactaattatacgctttctgaatagaatttctccaacacccttcagtgcctgcaccctttaatcatatctcattacatctacctaatccatatctttttcgcattgccagggctcattaacagttttaaaagccaatcttggacattatcactccttgtaatcgaaatgaaaataatgccaataatgttgtatttctaaaataaaatggattatttaaattttgttctgaagccatttcttctttaaatattaatgagaaattaactttcaaacatgcattaagctagcaggactggtaagatgtgtctgaaaaccctgaagcaccttttcaaagaagttatttttataagctgttttaacagtggatcatcagtcactttgaagggaagtgatccttgattaacagttggctgatattgtgtttccacagatgtgtggcagcaatacaggtgctatgcatgaaatagtacaggtaattcacaggata

SEQ ID NO: 467 - DNA, 8000 bp, Homo sapiens
  Locus number 79 genomic DNA region, cystic fibrosis transmembrane conductance regulator (CFTR), cAMP- dependent chloride channel
aaaaatttcttaaggaatgagaaattccaatgttcctgagaattctgatagcttttagagagttcagttttctgtagcattccattttgcaatcctatacaaatttctaatttataaccagtggtatgtaatgataatttctaatatttattaagtgtttattgggttctaagtgctttacgtctgatatatgtatcacatttaatttatttcatccagtggttcttaactggggacaactttgtacctctctccccaacatatttggcaatctctggagatagtcctggatctccagatctatctgtcacaacctaggatgtatgtggtcctacgagcatccagtgaatagaagctagagatactgctgaacattccacagtacaagggcaacccccacatcaaagaattatccacacccaaatgtcagtagtactgaggtagagagaccctaacttaatctgttcaacaatcctatgaggtgattttttttttttttttgagataaggtcttactctgtcacctaaactggagtgcagtggcatgatcacagctcactgcagcctcgatctcccaggctcaagccatccacctgcctcagcctcccaagtagctgagatcagaagcatgcaccaccacacctggctattttttttatttttttgtagagacaaggtcttactgtgttgcccaggctgatctcaaactcctgagctcaagcaatcctcctgcctcagcttctcaaagttctgggattacaggcatgagccatggcacctgaccaaggtgagtgtatttaacctcattttcaggcaaggaaacaaaagacagaaaagttaagtagcttacttaaggtcacagagctaagtgtggtgccaggattgaaaacctagttctttattgctttagcacaagctatttccactatactctgtcatgttcagagaatgttgatgtccatcagtggattctaaattttgaaggatggagatactgccttattctgtacatctgctttagcacccaagctcttgcttggtgaaaaattaatagtaaacattcatcttttgagcatcttcaaatatcccctttagaatgacattcaattattaggtcagtaaccccaagagaaaacggttgtttgagtgtatatactgtattacaaaataaggggtgaattcaaaggaaaacataagatgcaattcgtgcctccaaggaggttgtagggaagaggggttatgaatgtatgtaaatagaagttggtgtgcgtgtgtgtttataaacagaattgtcagaccaaacattattttggaagcagtaaaagtaaactagaatctggcctagtcatgtcccaggacacctctttcaagtcctgaaacatctttgtaagactgtaatgtgtgtttacatcctaggtaatcactgtggcccactgttgaagagctgtggctgttcttacccttctagcttagataaacttataagcacaaccagactacatatatgaagctgaagagaccttgtctttttttaacgagcttttcttcccgataggagtgactatttcttttcttcttccacattttcaggttttagtgtacttgtgattgctacccacttatcactattaaagtctactcaggagagaatctgagaaacactctcaaattaagttgaacatgatggataagtaaagtattgtgaaagttcactctcatgatttctaatggtgaaacctggcagggtgactaatctttgacgagaaggttatcacttataatctttcatatattgagatcatttgtaagaagcacccagcacattgctgaacacaaagtaggtattaaataaatgttggcttccttttctcctactcatcctcgctcttctttttaatatacctttaaaatgatgccacagaaatggccacccaatcttctatatttaaggtcagttcttgcattaggaaattctataggggaagtatgtgaagtatgtgtagtcagtcattaaatgcttgggctctggccacagattgtttaggtttaaatcccagtttcctcttttattattaattgtgcaacttgcttgggaaaacatgaaacttgtttttcctcaggttcattatctgtaatatatagtgaatgaagaagtttcctgtcccatgaaggtgttgtaaagattaaaaaaggcaaattaggctgtgtatttgtcataataattggcatatatggtaagtgaccaacaaccataaggtattataaaattgttataaaatgatatgagctatcattgagcagcatgaaagaagagcttcactgtttcacctactatcaccctggcccattaatctctttcctgttcctgacatttcagagatacgtttaggatttcaatcatgaccttaagccacatttgaacaattttctggtggataagtcctcattcccacattatgtatgtacctagatgcaaatcctgaatatcatgtcgcaattagtgcatctggacatgcttgctaactgtgttaaagctctgaataatggtaaagttttatttctaccaaaacaaatttgggctgtaatgttttatgataaaaatctgtggtcttcctatgtacatgtgtgtgtacatgcttaaaatgcaatgttatagttaaatgtaattcattaaaagtatgtaactccagtggctacttagtttggctacttggtttgtagatttctgctttcctgtttcattgttaaacaggtctagaagttattatttcatgaaactaatgtgaggaaaaagactatgttgatatataagtgacattatataaatacatgagggatgatttgattagaagcagtattacacagtgataggagtaatggtttagaactagactcaggtttgaatcttagctctatcattataggcatttacttaacttttcttgtttgcttaactgaaaactgaagataataacacctatttacatggttgttataagggttatatgaataatgtctggcaaatagtaagaactcaagtaactgtttcactctttccagaaggagattggctgaaaaatatttggagtctcctccagccatattccttggtcagcttctatgatcctctttggagcttaattcttaatccctttattttcacttgcttgttgataacaaagaagaactaattattaatttatttcaaaatgcatgtattatatttgatgggccacactaacagttataaaccaaacaacagattgggaatggggaagtggatgtggtgagttcaatcacatgtctgggaaaagtcaatagtgaagacagagtctcacaattttttgtcataatggagagatgaaaacacaggtagaggatttcaaacaacagagtggatggtgagttaaaaatgctgaaattctttcctggtgtctaacttaatgcaatgtggtttatctctttgctcttttctctactattcaaatttaggataataaagattaaatgtttctaaatcttactttacaatatcaagaaaaaaaggtatgcttttgcccacggaagggcaaagcagagctatgaaaacctgctgaacacattctttattttcaacacaggttcttgtctttccatcatgaaatgcacattttatttgtactgtatttgggtgaccacaagtcaacaacaagataattcacaagacccttgccttagatgtgtcggcaataaagtaatcaggccaaaatttttactttcctttgaatttttcaattcaaacacaatgtatgcttgcttttacacagtagggttcagggattagagggttggctctttaaaaaccgtcagagacacaggcaatcctacacaaaattctcagaaggaaggcgcctacgcctgggaatgcccagatgcccctcagagagttgaagatggcgtttctctgagtcaggtcaaagttaacacattaccttcgcttcaaagactgcttggcttcctttcggtggattagtcaagatgttttgctgactgagactaggaaatctataggagggcgggttagtttacattgttccttgtcattatcgctaaaacactccaaagccttccttaaaaatgcgcactgggctaaaaaggatagacaaggaacacatcctgggccggtaattacgcaaagcattatctcctcttacctccttgcagatttttttttctctttcagtacgtgtcctaagatttctgtgccacccttggagttcactcacctaaacctgaaactaataaagcttggttcttttctccgacacgcaaaggaagcgctaaggtaaatgcatcagacccacactgccgcggaacttttcggctctctaaggctgtattttgatatacgaaaggcacattttccttcccttttcaaaatgcaccttgcaaacgtaacaggaacccgactaggatcatcgggaaaaggaggaggaggaggaaggcaggctccggggaagctggtggcagcgggtcctgggtctggcggaccctgacgcgaaggagggtctaggaagctctccggggagccggttctcccgccggtggcttcttctgtcctccagcgttgccaactggacctaaagagaggccgcgactgtcgcccacctgcgggatgggcctggtgctgggcggtaaggacacggacctggaaggagcgcgcgcgagggagggaggctgggagtcagaatcgggaaagggaggtgcggggcggcgagggagcgaaggaggagaggaggaaggagcgggaggggtgctggcgggggtgcgtagtgggtggagaaagccgctagagcaaatttggggccggaccaggcagcactcggcttttaacctgggcagtgaaggcgggggaaagagcaaaaggaaggggtggtgtgcggagtaggggtgggtggggggaattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttgggtttggggtaaaggaataagcagtttttaaaaagatgcgctatcattcattgttttgaaagaaaatgtgggtattgtagaataaaacagaaagcattaagaagagatggaagaatgaactgaagctgattgaatagagagccacatctacttgcaactgaaaagttagaatctcaagactcaagtacgctactatgcacttgttttatttcatttttctaagaaactaaaaatacttgttaataagtacctaagtatggtttattggttttcccccttcatgccttggacacttgattgtcttcttggcacatacaggtgccatgcctgcatatagtaagtgctcagaaaacatttcttgactgaattcagccaacaaaaattttggggtaggtagaaaatatatgcttaaagtatttattgttatgagactggatatatctagtatttgtcacaggtaaatgattcttcaaaaattgaaagcaaatttgttgaaatatttattttgaaaaaagttacttcacaagctataaattttaaaagccataggaatagataccgaagttatatccaactgacatttaataaattgtattcatagcctaatgtgatgagccacagaagcttgcaaactttaatgagattttttaaaatagcatctaagttcggaatcttaggcaaagtgttgttagatgtagcacttcatatttgaagtgttctttggatattgcatctactttgttcctgttattatactggtgtgaatgaatgaataggtactgctctctcttgggacattacttgacacataattacccaatgaataagcatactgaggtatcaaaaaagtcaaatatgttataaatagctcatatatgtgtgtaggggggaaggaatttagctttcacatctctcttatgtttagttctctgcatgtgcagttaatcctggaactccggtgctaaggagagactgttggcccttgaaggagagctcctccctgtggatgagagagaaggactttactctttggaattatctttttgtgttgatgttatccaccttttgttactccacctataaaatcggcttatctattgatctgttttcctagtccttataaagtcaaaatgttaattggcataaattatagactttttttagcagagaactttgaggaacctaaatgccaaccagtctaaaaatgcagttttcagaagaatgaatatttcatggatagttctaaatactaatgaactttaaaatagcttactattgatctgtcaaagtgggtttttatataattttctttttacaaatcacctgacacatttaatataggttaaaaaatgctatcaggctggtttgcaaagaaaatgtattacaaaggctgctaagtgtgttaagagcatactcatttctgttctccaaaatatttcataaggtgctttaagaataggtatgtttttaaaagttaagttcctactatttataggaactgacaatcacctaaaataccaatgattacaaacttccttctggccttctggactgcaattctaaaagtgtaaaaaacatattttctgcattaagttaggcagtattgcttagttttcaaagtggtaggctttggagtcagattattttgattcagatcctacatctactgtttagtagctctgttgcctgaggcaggtcccttaacatctctgtgtgtgacttgacctttaaaatttggagactgtcataggggttaatcccttgagaaaatgaatgtgaaaagttagcctaatgttaactgctattattatggattaccatattttcacattcatcacagtacatgcaccttgttaatataagatgctcaattcatctttgagtataattttgtgactctcaatctggatatgcaatgagtgggcctgtatgagaatttaatttatgaaaaattgtgtttcacatggccttaccagatatacaggaaacacgtcacatgtttctattgtatgttgttaaatgccttagaatttaactttctgaataggatcccttcagtttgagagtcataaaagagtaaaattattatggtatgagttatagattgtattgaatatctctttatatgtctaggttttgtcattggaaaaccaaaaagtttggaaaaaaaatctaagttatttcttactttcttaattttgtgtggatttcacatcaagtataaaatttgaagaacatctgaactatcataatccatatatatatataaaataaacataatctaagagagaatttcaccatgaaaaattcaggtagttcatgactatcagagcaaacaagtacattaaattgaaacttttatgaaaataacatttatgaaataggaagctatttttaaactagaagtgatatattagcatataatttataattcatatacaagtgggattgatttataaatggtcaccaacagagattgtgctatttaatttgggaaaattttttaaatttacattttctcacaacttttaaggtagttattcagtttgttcctctctgtctcttctctcatgccctgaatttttcatatttcgtttagttgtaagagtgtatatcaaaccgtgtgtcacatgacataacttgaattttcgtcgtgatatctgtgctatgtctaggtctatactgaggaactgtgggaaccccacagaatccaagtatacagtgccactgatttcttacaagggatgtggggtctcctgtaaactctgcagttagtctcaagtaagaccaaagagtaaaatatt

SEQ ID NO: 468 - DNA, 8000 bp, Homo sapiens
  Locus number 80 genomic DNA region, Feature name ha1p_22519
tgtggagatgtttctgaactttcagttctattcctttttatctaagttggtatcaataccacatgttttaatgattataactttgtaataaatctggatatctggtagagaaagtcctctcactttatccttttcttaaaaactatggtggttattctcagttctttacatagccagatcaattttaggataagtatgtcaagttccacaaagtatcttgcttggatttcagttagaattaaattaaatttgtaactttatttgggaaagaagtgatatacccatggtattgagtcttcctatttaataacatggcatatttcttttgcgatggagaataatatctttttttagtttttaaaatactgtcatatagaaactactactaatttttatatgttggtcttgtatgtagcaatctgactaggttctcttattagttctaacaactttatacattctcctagactttctataaagacaatattctaagtattgacagttgtttccaattgtatgacttacttattttagtgtcttattgcattttttaacccctttagtacaaagtggaatagtagagataataccagctatctttgtcttgttcctttaatcactggtgtggtatattacattaagagattctctcattttttttttttttttgagacaaagtcttgctctgttgcccagactggagtgcagtggtgcaatctcggctcactgcaacctccgccttccaggttcaagtgattctcctgcctcagcctcctgagtagctgggactacaggtgcatgccactatgctgggctaattttgtatttttagtagagatggggtttctgcatgttagtcaggctggtctcgaactcctgacctcaggtgatccactcgcctcagcctcccaaagtgctgagattacaggtgtaagccaccatgcctggccacattaatagattattaagcatgaggcatttcttggataagtcaaacttggttatgatataatacttgtgtgtttgtgtgtgtatatatatatatatataaaacaagaatatattacttgtataatatataaataataaaaatataagaaatttattacttatacaagtaatatacaaatgatatataaataatatattactaattactatagtttatacatggtaatgaatattaatacatagtaacataatatgacattacttatcaattattatatattataaatctggtcacattatattactgagtaaatgtaacatttactcagattttttatgcccatgttcattagtaattttgctgatttttttttaatactctttgtccagttttggtttcaaggttatactaccatcatagaatgagctgggaagcctattctaattagctatttgttgaagcattttacatattttgggataatgcattccctgaaggttcagtaaaatttattttgtgctctctttaatggttagtggtttgttcagattttcttcttcttcttgagaacatatggggatataattgccttccctggcttcatatttccttgtggaggaaattctacacataatgcccctgacctggagctttattgctacaatttctcctctgtggagaagacaggcagatgactcatgagctcagctccttctgggctcttactttcaaggctgtctgcttgcaagatttatgttctagtcagctgtcttccatagaataaggggactgtatacttgtgtggggaggccaaggttgtgtgtgatgacagactaattatgccaaattcctgagcaaattattgcagtctacttagctgcagatcaacaccattttctctaaactattttatcagtaacaaagatgatattttgacctacatctgcctgactatatttgatgatacagaacttgggaggggaagaaagggtgttattctttaaacagcacagatatgcaatgaaatttccattaatccagaatatacatagtggttaacatgcagtgatttgaaataaaatattatttgaaaagctatttttatagctgcaaaatattgcattgaagaggctgccaccaattatttgtttccatatgagcattttaaaggctgatacacaacattttaaaaatgtatatgcaccttgagaggcccaggcgtgcagatcacgagatcaggagatcgagaccatcctggctaacacggtgaaaccccgtctgtactaaaaatacaaaaaattagccaggcgtagtggcgggcgcctgtagtcccagctactcgggaggctgcggcaggagaatcgcttgaacccgggcggtggaggttgcggtgagccgagatcacgccattgcactccagcctgggcaacaagagcaaaactccgtctcaaaagacaaacaaaaaactatatgaaaaagtctctcattattttcacaagcattaagaatctcacttaaaaacatggctgggcgcggtggttcacgcctgtaatcccaccactttgagggggcgaggcaggcagatcacttgaggtcaggagttcgagaccagcctggccaacagggtgaaaccccgtctctactaaaaatacaaaattagccggtcgtggcggcgcgcgcctgtaatcctaattactcgggaggctgagacaggagaattacttgaacccaggaggcagaggttgcaatgagccgagattgcaccactgcactccagcctgggcaacaagcgcgaaactctgtcgcaaaaaataaataaatacatacatacatacatacaaatattgccaatttgataggcaaaaatatatgcaaattatgttttaacaaatattaataaagttgaacaatggcccaatgtaatttgttacctatctgaaagacatgcacattcagggagttacagtactttttcatgtcttgcagcatcaacaaattgttttctaaatgtggaaaaagagacattcagtacaggctaacgtaacgtgggacagcatgcaaagccatgagaagtgggaaaatgagagagaatctgggcgtggcttacagggctgctgaagtaagacacacccttcgcttcacctgtggcctcccgcggcggctgcggctccttcgcaggaccggtagggggcgcgcgcggttgagtccagcaattgcgaggacctccgcaggcgcagcccagcactgacgcctctccgggccgtggctcctctttcccaggccgaaagcggccgggccctctgctccgctgcgccctggcgcggccgcacccactgcgcgtttgtgagctggccatcggtcacactgggatactcgaggaggaggcctggggcctgcattcaattccctaagagggacccgcgctggccgctgcaggcgggtggagaacgggcgtctgagtctttggctttcgtaccggaatctccccgggagattttacaagcccctccgaatgttctgattgaattggtctgggggggtcggtccgggcatctaacgagcagccgggatggagaattactagtctggattctggtcctcagaggttcactcacgttaatcaacccgagtccatcttggtgggattgtcttgctccgaggccctcccactgagctttattttcctgcctgatttcggggtccgctaacaggatgaacagcggaccatacaggcacggtgaaaatgacacttggtgacgtggaagacccagcttgccacagttgaggcagagctcctcagggtcttttgtcttagttatccccgagctatttttcaggaaccgacaggctcccccaccccaacaccggatgaaggccagcaactggaggccaggaataatcaagcacgctctcatttcaaagaggtgacgattgtgcccgtgtttaaaagggatgcctgagaccatgaggatttggagttttggaggcggatctgcctttggggagtgagcgtagggccctaagatgtggttgtgctttgagacagttcccagggtgatgtgtcccatcatccaaacattgcaggataagtcaaagttacagaaagactctagtttacttccagcctaacattaccaaaatacggtatttgtcagaaaacatgtagtatttgtataatttgagaatgtaattgaagaacccgatatagagcttttagaaaggggaaatagaaaacttaaaaagaatcttgcttggtatattaataccaacatctaaaatataataaaattgaataaaccagtgagttttatactatgattgaaataaaatgccactatgttcttaagagtgctagtttaacaggaaatctccaatgcattattatctagactcatctcaaaggctcacttttcatttgcatgggcccttgctatttgtagggtaggaggcagcacctcgttctggtggctgccaccttcatgaggagacactccttgttaacaggatggttagcccacggctcttcccagcccccttttccacacccagtaaattgttttagtttatggccctcagctgcagttgcaatcatcatcaaattccagttttgaatttaaaggtgaataatgaatgcaatgaactttctagaatttatgaagggcagtgatgttcctttttatctaataattctacatgtgtagcctttcagtatgctattctgtggactgaatttacaaattgtcatttgtttaatgaactgttaatataacatgatgactaactgaaaacacatacaatttgctggtattccagaagtctatggatttcgttgttttgtttaaataaaaggcattaaaagcagctgcttagtatacttaccttcttcactcagcataaggtagaggtgaaaaaaccttcttaatttggcaatttatataaccttttgtttttggaatacagttttcttcccctttacattcgttctttagcctaaatcctaagtttccgacttgcgatttaaactccacatgagagaacaggttggaattttatctttaataattttatttataactcgaaagtaagtttcaaaatattttgtcatagtaactcctataagtgtttatttaatccatcttgtaaattttctatttctgtatctttaatatatttaactattcatttgactgttaatgactaaaaaagggggaacattaacttcactgcaatcaggaaaactctttcaaactgttatataaaagaatatatatggtgtacgaacacccatgtatttttaaaaagtaaataacaggtaaaccaaagctcagataaaatccaacttttaaatatatataattaattgttagagaactggctaaaataaagatacaggttggcttttcttcctcctaatggttatgtgtacaaaactaaatttagtattaattgaaagcaaaaaacccagaaagggaaaatggcacacatttgatttaggtgaaaattatttactcatttttctatctgcaggtgatttatcattttaggttctttcccttccactgtccaactggtatataatcagtaaatacaaacaaaaataccaacatctgtaaaatataactaggaaggcacgctatgaaacataacatagcatattccaaaagtcaacaacggatttgctggttactggattgaaattatacttatttgctcataaaattgagttcatggcataattacataattctgtggcaaagcatttggtatgctctaggggagacatgttttaaaaacaattgccttgggtttttttaattttaaaaataattacaaattttatttttaattcagggacatgtgcacatttgttacatgggcatattgcatgatgctgaggtttggggtatgattgatcccatcatccaggtactgagcatagtacccaaacgtttttcaacccttacccccatccctccctcccacctccagtagtccccagcgtctgtttttgccatctttatgtccataagtacccagtgtttagctctcacttataagtgagggcttgcggtatttggttttctgttcctgaactaattcacttaggatagtggcctccagttgcatgcacgttgttgcaaaggacatcgtttcattcttttttgtggctgtgtagtattctatagtgtgtatataccacatttcctttatcaaatccaccgttgatgggcacctaggttgatttcatgtctttgctattgtgaatagtactgtgatgaacatacaggagtatttgtcttttgggagaataatttattttcttttggatatataccaagtgatgggattaatgatgaaaaggtagttctaagttctttgagaagtctccaaactgctttctactgtggctgaactaatttacagtcccactcacagtgtataagcatttccttttctccaaagctttgccagcatctattttttcactttttagtaatagtcattctgactggtgtgaggtggtatctcattgtgtttttgatttgcgtttctctgattattattgatgttgaacattttttcatgtttgttggccgcttgtgtgttttcttttgataagatctgttcatgtcttttgctcatttttaatagggtttttttttttgcttgctcaattaagttctgtatagattctttagaattttagacttttgtcagatgcatagtttgcaaatattttctcccattctgtaagctgtttactctgttgatagtttcttttgctgtgtagttttttagtttaactaggttccacttgtcaatttttagttttgtttcaattgcttttgaggacctagtcataaattatttccaaaggctgacgtccagaattgtgtttcctaggttttcttctaggactcttacagtttgaggtcttatatttaaatctttaatccatgttgaattaatttttgtatatgctgctagtacggatcaagtatcattcttctacatatggctagtcaactatcacagcaccatttattgagtagggagttcttgtcccaatgcttatttttgtcaactttgttgaagatttgatagctgtaggtgtgtggatttatttctgggttctctattcaattccatccgtctatgtgtctgcttttgtaccagtaccatgctcttttggttactgtagccttataatttgaattcaggtagtgtgatcctctagctttgttctttttgattaaaactgctttggctattagggctcttttttggttgcatataaattttagaatgtttttttctagtcctgtgaaaaaccatattagtagcttgatagaaatagtgttcaatctgggccaggcatggtgggtcacacctgtaatcccagcactttgggaggccaaggtggatggctcacctgaggtcaggagtttgagatcagcctggcccacatggtgaaaccccgtttctattaaaaatacaaaaattagctgagtgtggtggcatgggcctgtaatcacagctactcgggaggctgaggcaggggaattacttgaacccaggaggcggaggttgcagtgagctgagattgtgccactgcactccagcctgggtgacagagcaaaactccaactcaaaaaaaaaaaaagtattgtctgtcgagtgctttgggcagtgtggccattttaacaatattgattcttccaatccatgagcatggaatgttttcccatttgtttacatcatctatgatttccttcagccgtgttttatagttctccttctagtgatctttcacctctttgattagatacattcctaggtattttatttttgtttatggctactgtaagtaagattatgttcttttattttattttattattattatactttaagttttagggtacatgtgcacaatgtgcaggttagttacatatgtatacatgtgccatgctggtgtgctgcacccattaactcgtcatttagcattaggtatatctcctaatgctatctctcccccttcccccca

SEQ ID NO: 469 - DNA, 8000 bp, Homo sapiens
  Locus number 81 genomic DNA region, Feature name ha1p_31800
aacgttatccagaaattcaggagacccctccccacaccttacatcagaagagaaacctcaaaaggagaatagttaggcagaatagaaaacagtcatgtcaaatagcattggcctaaaatccacatagtagaacattggataaatgtataatctttcttgcccagatcttcctggaaacactatctgttgcaaaactttctcctatcaactgtttttggttaatagttcagggatttggtttagtaccttggagagctatatatccaagcattttgcttgtcaaaactatttgatagctgtatttgtaaaagcagtggctcaaatgtttttagaagagattttcagctgggtggggtggctcatgcctgtaatcccagcactttgagagaccgaggtgggtggatcacttgaggtcaggagttcaagacaacctggccaacatggtgaaacactgtctctactaaaaatacaaaaagttacctgggcatggtgacaggtgcctgtaaccccagctatccaggaactgaggctcgagaatcacttgaacccgggaggcagaggttgcagtgagccgagatcatgccactgcactccagcctggtgacagagagagactctgattcaaaaaaaaaaaaaaaaaagagaaaagaaaagaagacactttcagtagaatatgttccaaaatgaatagggagcaagctttctcattggtagtcaatgttctgattctttggatgaatcagaaactcaaaaggttgaaatagtcagataggcccatttgagtatccaagagatctactggaccaagcaatctaattacgtggacagtttactcttttacttctccatcctgagaaacagagcctgatcttgtaagaaaggattccaattcatcctctaaaagtaaaactatgttctttttagcctgtgattttggagtctctctgccccttggagtggtgtttctgctctttttctccatagaatccatctgaactggcctttatccccctgggctcgaatttcagttaggaaaggcagagtattattgccacctattgccatcagttcttctctgtgcttccaataagtgagagcttctcgtaggaaagttaagaagtaatgtgacccagtgcactggctcatgcctgtaatcccagcactttgggaggcagaggcgggtggatcacctgcggtcaggagttcaagaccagcctgatcaacatggtgaaacccatctctactgaaaatacaaaaattagccaggcggtggtgattacaggtggtgagcacctgtaatcccagctactcgcgaggctgaggcatgagaattgcttgaacccaggaggtggaggttgcagtgaaccaagattgcgccattgcactccagcctaggcaacagagcaagactccgtctcaaaaaaaaaaaagagaaaaaaaagaaaagcaagcagaacttttatagggagccaagacattatcttctttgttaaaactgagagagacagttgctaatagggtttttttttttgtagaaagatgtgcttggtgatgcgtttgaagactcagggccccacagcagccttgctgttgccacctcagccagacaggcccggcatcccaaacatcatacaaccaaccccaggcaaacactctcttaaaaaacccagatagtgaggggttgtgtccttctttcgaaggtgggatcacactgagggtacttggatgcaggtgctccaaattaccccagcctcaaacaagtttgtcgaactctaggcaagctgagtatatactcatgggaaggttaataaaaatgggaacgaaccccatgtttagaaacataatggagaacattaggcttatcgatgcctctaccatgcccacagcatctctggggccataggaaagggcctggtgaacattttataaccaggcattccccagctacagcatattaattgtgggtgtgaattaaatcaagggagggagtggattctccctggagcttgaggaaaatggtccacttactgtgctttttcacggttgcattgcccttcctctgatgctggggagggacagaggaggggcagtggtggagccagttaccaatacagagaattgggaagcagttaggtcctcggcaatgaatgcagtttttgaacagggcttaatttataatggacactcaacattaattttctgatttctagacatttttccatgttgcccatttcttgtttatctcttagtggagatgtttaagtatttataggcaagggagggagatgttaagttcctaaatacctaggggaatcctgtgacaaaatagtattaagaattattttctgccattttatttttattttattgtaaattgacaaattataactgtatatatttatggggtatgatgtgatataatgacatatgtgtacaatgtgggatgattaaatccagctaattaacacatccatcaccacaaatacttgtcatctaccattttaaattgcaaaaatggactgaaggaccacagtccttcaactgaaacccttggagtcagttgtgtttcagaattcagaattttattttagaaaggtaatagaaaacatatgctacttattatgaatcactcctagcaggatctgggaagattcttagaacctataatattaaacatttctgtagcaaacatgattatttgctctaagtggaataagtaaagatttttaatagcgtcacgtcacttcaagttatgacactaaatgcattttggagcgaaacttacaaaaaacaatatttttaaaactttctggattttagacttgtgagtaaagattagattttatataaatcgcattgtgagttagggagtgcttaatggactggccttggaagccagtcagtatttatggaaaaaaaagtgtgtttcgaacgaccaataaaatgaacttttggaacataatccatttgtcatttaaggactaacagtattaataaaaatgactgagagtcagattttgaactgtggacaaagctaatataaatatattcatattaggcaataggcactgccaatagatgagacttcttagctactccttacccacatctcagctttgatgatgtatcttctctctctgttacctttatttccctgttatctcctcttttttttcttaaaaatagttagtttgtcctagatttggagcttataacactcactctggatagttggcaggtcttaatcagggcaagtagacgaggtatagaaacccagtgatttcagtcttacgggatccaagcaaattttttaaaaatatataaagatgattttttaaattcatagagtgatatacctttaaaattgtgtgacagaattgaaatgacagggttaaaaatctcaggttaaaaatcactgagaaattcagcttttatttgaggaaaacatttctgaactatcactgacgtaaacaaagtgttttgtttaaacaataaaagaacctcatatctataggaaatcctgaagttacattaaaaacaaaaatacttaaacctagaagctgttacaatgggaaactagactataaataatttgtgaccggtgtgtcactaggaattccaatggcataaagaaatgcttaataaacaaattgcctttcaaatttggcaactctggggatataacactatgaactgtttttttaaaattctgtctgtataaaagacctggagagcctaactatactgtggattcatttcatcgtaggtcctatgaggtcattgcaaatctttgtactatatttgagaaaacagttgcgctgtccccagcatctaatgtcatgacagccacgaggcctggcacctgatttctccagcactgtgttcacccttgtgtcctgacagcgtaagcagtttttggtgtctttgagagtcatctttacacagccaaattaaacgaaagaagtgaagtagggccttcctgtgttagtcagtctttcctgatcttcacatttctttagccacagatgataacggactgtagaatcccctaacctcttttgacagttctttcttgaattattagtgacattcggtgaaaatatttgaatttctctgttaggataggtgagcagaaatgctgatcagaaatagaagaactagtcatgatgaacataactaaaatggaatggcaatactcaacttcctaatatttatttggaacagagatattaaagatagtctttatttttcaatgttttatctgctactccctgcctcctcccccaacaacaaccaaaacactttaaaattttaaattgaaaagttgcccagtcattcagtgaggtcaatgataaaggctgaaccatatttagacaaaccccaaggaaaggataatgtattgtatttttaaatattcctttttaccttttcatgatcagtgcctcttcctgctcctgtttgccctggcatcttttggaaagctctgtgttttgcatagcatgtgcactttttttcctgaaatgtgcaacacattcaacattgcagtgatttttttccccctccttagcttagagcagaggtggaaaccccaggggattcaagtacccacttgataggctcagtctctcttaatcagcctgtaatggagctaatggctgtttgtcatccttggagatataaatttcctggcggtgtctcctgcagacagtgcatgaagtatgctcagtgtgccagcaagggctgataatcagcagaaggacagggtgcttcgttagtcagaagagccagggcttcccggctgccaggctacagaactcgcctcgccactcctgagacatggacaacgccggtgggtaaatcaagcatgaattcttcatagctgctggcttcctttgcagcccgcatcctttactgcggaaggtttgcctatttgttgctctcgttttgcacttaaatgttcaagactgagacgcgtgtaatatgtgaaccccgatgcattgtccacaagacaattagtgtttactttgaagtttaggaactgggaatgcagattgtattccaaattcaccttttgtgaagactactgctatttaggctgaagcaagtgtggtgtttgattcttttgtgctcagagcgatgggtggaaaatgcatacagttagtgaaaaaactattactaagggatggcacaaggtagatggaattaagttaatgagctgagcaaaaattctgtgtaaatattacaatatgcacagtgtaacagcataagagctctttggtctgatgctttcatcttcacgttaggatgcaatgtcgaaaatgtttcgatagcctctgatattttaatttcagaatagagacattagtggtcaattgtgaacctttaaaaatgtacttatttttagtatctttacttgataactagacaaacagatgattgaagtatgttaatgtcaattaaataattagcataaaattatcaggtggaacttttttctttttactttgctgtattgaacttttagaggagatatactgtgagatcatgccccatttcagtgttgtcggcactcaagcagaattctcccagctgtgttatggattatctgtctcctgaagctcattagttcagttacgcagctggtatcagcttgaaggtgatgcttcccatgccttgagacacggtcagctcttctaagaggttacatcatttaaaacacattctacactacaagaccacccattgatggtgaaacatatttgtttatgaaattgagctagttcagtcctcggcacaggtagcataggctagcagagattttaaagtcagcgtgtattaggttcttttatgaaatagcttaccaggaacaaaactctgtgactaacattatttggtcattgccattgaagatattgaaataaagtggaacagtataatatcagggatgaaaatgttagggtggtggaagaaatgaaacaagtgtaaggatgtgtgtgtagtagtagcaggagtgaagctggatgcatgtatatggattatacccccattctggtcattaaaaaaaatgtactatagggcttgtcataaaagcaggtaggtatggtattccatgacaaggcacaatttgaagatcaaccaaaagcttctctaattacagtggtagagtgagtaaaaattaaataaataaacttagaatctctaatttagcctcatttaaaacttctgccacccacaatttattatactgacattctggcagaacgatcactttaattcaagtaaatgcctttttaaactgactcatatatttatttaaaggccatttaaaaaaaggaaagaaactcctgtggcagactttatgtaggcttaaaaatgctaagggttatttttcttttttgggtaactagagctttgggggatgttttcacaatctctagttatgttattaaatgcaattaataaaatacctctgctcttgatgagtttaagattatttaaacactgtggagagtggcttgtaaagtagcaatttctatatcatttcaaattttaggtgtaatctcaaatatagccatacatacctttgaatagaataacgggttttaaatcacataatttgaatgcttcagaaatagcatgtttcttataatggcttataattggctgtcagtgatcacttttcatggtaattttttgatgaggtaagcagcctctcttacaggaggaaaatgtaaacatccattatatacagacatttcaatacattatattgactgtaagggaagcatttaagataaaactggtaagtggcaaaaaaaaaaatctgaaaaatctgaaataacttggagcactacagtttctccaatttaatttaaagaagataatgatgttgagtatttgcctaaatttttctaatcagaaatgaattgaggccctggatttcagagctagtagtttagagcggggcactcgtactgacaactggatcattagtttcaaggagccagaccttcttctagcaaggctttctgtgtgggagtttggataattgacaggcagaagcacagcaatgggtccacacaggttgaatgtccctcatttattcaagtcacatagaacgctgcatcaggatatttgtgcatggtttctgctgttaacaagtaaagtaagatgagctgcttgggactccggcccttttggtgggtgtgtgtacatttcagctatcatggcattgtgaatctgtcctttctctccttagcagcaaagagctgacattcctactatctcagagaaggagacatcccttccccataattgctggcttctgtattcctttaaaagcttttcctggaataacaataaaatatttatcaaactgtgtgtgtggaatatgtcagggcaattttagcaatatctaacattttcttctttttttttcaaatggctatttcttcttagaagttatataacaagtcaaatagatggtgctttagaatggcacacctgtgactacaagcatcatcagcattctgccagtgccactatcctccttacctccatcaagtggttctcgtgaatgaactgtgataagacattcagaggcaaagttgattggtgtgtgttttttatctgaaacacaatttttgaaatgtaatcccatattctacagtgcagagtactgttaaaaaaaaaaagttctgcagaatttattgtgttgggttttccctacttgatatcaagatatttcagttaccatgtgtgggttgaaagagccacactcatttggaggggaggtggcagctgctgagagcccctgcgccttcaccgtgcattctagctcagtggttcaaagccttttgacaattgatgtacattcattgagtttgagaaggtcacagtctgccagctccctgcaaaagagactcgagagttatttggagccagactgaggaagggtttggagtggagtagtcgagagcatcagataattttagctgaac

SEQ ID NO: 470 - DNA, 8000 bp, Homo sapiens
  Locus number 82 genomic DNA region, chondroitin beta-1,4-N-acetylgalactosaminyltransferase 1 (beta4GalNAcT-1)
tgacacgtgcccataagaagaatgtgggtggtgccagaggactaagtggagccatcttcaggtaggagacatccctttattcacttttccattcattcactcgctcattcattcttttgtttggtgccttataagagccaggcactggtcctcaagctagagtacaggaacacactaccattgaggtgaggtttgaagctccctggtcagtgatgagaagaaagtatgctaggtagagagagtgtggacaccaacacagcttcaaggagtgacagctggggaggagtgagcagaagggccagaggtgggagacaggaacaggtggagacaaaagcacaggtcggggagggggagcacagagagctagtgtcaggggagggggagcacagagagctagcatcaggggacaggagcatggagagccaacagcacatcttttctttgataggaggaaagcaattaaggatttggaaatgtggttccatttcgtggtagggagaggcaggaaatatatcagtgagcagtgacaagatacaaggtggccgtaaaaattgtgagcagaggccaagcatggtggctcacacctgtaatcccagcactttgggaggccaaggaaaaaggaaagaaaggaaggaaggaaggaaaggaagaaagaaaaagaaaaagaaaagaaagaaagaaagaaaaagaaagaaagaaagaaagaaagaaagaaagaaagaaagaaagaaagaaagaaaagaaagaaaaagaaggaaagaaagaaggaaagggaaagaaagaaagagagagaaaggaaaggaggaaggaaagaaggaaagaaagaataaataaataagtagtccaaagctgattaaggtctacttgggcaaatgcaaagttataggatgtttctgctctaaagttaaagctaccacagtagcaggacagggaacacttggggaacctgggaagcccttgttttcccagaactgctccttacttttatagactcagggcttgaacatccttcagcagcagaacttcaccagacttgaaagaaaccaacgtgcacattgagaagacagcaaatgagttgtttcctttctttttgggcagacaaacctaccccacacccagtgcatgcttggcaatcacaggatcccagcaaggggagttaattgttccattcaaacatttagtagcattaggccataagttgtgcagtagggatagccttgtgtgttaaacatatccttcatagagcttgctccaccatggttcattcttggtcaattgctgctcaccattcattcattcattcattcattcatttagagacagagtttgctgttgcccaggctggagtgcaatggcgtcatcttggctcactgcaacctccacctcccctgttcaagcgattcttctgcctcatcttccctagtagctgggttacaggtatgcaccaccatgcctggctaatttttatatttacagtagagatggggtttcaccatattggccaggctggtctcgaactcttgaccttgtgatccacctgcttcggtctcccaaagtgctgggattataggagtgagccaccgcacccagcctacttctctattttgtaaagtttattttgactgttttctggcattatctcaaggtcttactaattatggtctacatggggttgtaatgacattgctctcttttgtatcatccaagtaattctcaaaaacattaaacatcacaaggcccaagattaggacagttccatacgcccttcaagttgaccctgaattacttaagcctcttaaccacttgactttctacttaggaaaggatttgggaggaattctccttcagttatttttgtttgtattattaactttcagccaaggttttttttattttttctattgttagtaactgaaatacagttctttatgaaactccacacaccctcatttaagtacagggcagttcattaatgcaaaatcaaatcattaactactctggcttccattattttatcttaatagtgtgacaaaagtttttggaaaaaaaaaaaaagcaaaaccatcaagcaaacctctatagacatttgttaaatgaaggaggaaggtgaagggggctttctgaagatatgtatatgctgagtgcagcttacctattttcatttttatgcctattgaattacttctagaaaaaaaaaagactctctgctgaagcttggaaccatatatacagcttcctgtttcataccatcgcatgtcaacattaatgatattttacagtacttgttttattttgtattttttaagtttagtcttatcagatgtaataaaacatcttattgcatagaaactcaaaattactggttacaagagcagaactaaaacaacattccagagattttcatttgtccccggactaaaaccaagcttccaatccgtaagggcactattctcaaagagctctagacagtgtccctctaagacaccatatgtcagaaagaaagctcattcttcaatttccaaaaccatggtatttaaataattattttctagcaaagtcaaaattagagtacctatttgatgacagggtgactattttaaaaagctcagtattctgtcccaatttccaatgggagaacaaatgtccctatgtaagcgaactgtttcaaaaagatgtagctcttccagctctatgattggtttaagtcacttgccactctgagaagagataaatccttaaaaagttgggaaagttagatgtagatgtagatgttacagcctttaaaaagtgaatgaaaaggattcaatggagccaagtaattgtattattttggaagaagtatcattctcttgaagtaataacttgttactaatcaagctattgacagtagaatgaaatttcatacatttcaaacacatccagaatattgaacacaaagcagaccatgcaaaggtttgtttcttgagtgaaaatgctcacttacctgggggttcaagaagggaaggttaggaggtggctacatcattgctcctctgggtcaaaattaccttggcgtctttccttgaaataggaaggcagctaaaataaaataaaaacaaaaggcaacccttgtaaatttccatgtcttaaatgtatgtggtattacaaaatgggaacattttaaatcacttagtatataaaatacaatgcatctgaaagtattaccccaaaaagcaggatggtatttgttctctccctgtttcaatgaataaaatgcaaactatttgtttaaaaaaaaatcaaggctttaaacagtgataaccatgtctaaaggtgtctaaaaatgaagctgaacattttcatgtgaaaaagagcaaatcaaaaaagccgatctcgcaggaaagaaacgtgcccagctgccagcgagccgcttcctaactcgcagctctgcttccaatgctctgacagcgctgaagtcacactggggtttccaggttggggtcaggagggaaagtgctgcccccctctgcaaggactgtgttcagcgccaccacttaaaaaaaacggtttcatgaaatgaaatgttaaaaaataaaaaatttccttttttccccagagaaggtaagagcgcacacgctggaaaacggtgggagcagggaggaacgaccgccttcccgaagcaccgcagggttcgccgcacaacgccgctggtgaggaccgagcgcatctgcccacagcgccccagccgcgcctggagcctcccgctccccagggagaacggtgggcgcgtcccagggaacacgacacccaaggagagggcgggcgcgagtcccaccgggtgacccgctccctggggggcgtgaagcccccagacctgccctgcccctgcctggagattgcgccttgcagggagtgacaacgggccccagccgtcccttccttttaggaatatcaatggaggaaaccgatgtgtcaactagataaaagcagaatgggaaagaggtgcaagcaaaatactctggaatgaagggcaaggggaaaatactctggaaagggactaagcccttccagttaatttcatgtcaataatgttgtcttcaattaacgaaggcacagtcctccttcccgagttgtcaggatttttatcccatctgtctttattattcgaataacagcaaatatccatctatatatgtatttgctatttttatatatatatatacatacatacacaaatatattcatatatacaaacatacaatttgctattactgtgtgtatacacacacacacacacacacacacacacacacacacacacagaattgctcccatttcacatgcaggaattaaaaaaaaaaaaaagtagaaagaaagaaagaaaagaaaaacaggcccagaaagcgccaaaggaaaattgctaagtctcaggtctaaagacagctggtccccagttcctccatggggatggcctccaaacacctctccaaaggttttctctgactcactgacatgaacaaagtcagctgaagtgtgaggtgtatcactatagaggtttagagtctattttgtacccacccactctcaccccagttcactgtgggtttactgttggagagggttgccgactgcctagggccagctcttggccccaactcggtcctctactgcggtgcctgcgcggctcccaccacccacttccgcctctgcctggccaatcaatctatgtctacaccaaattgcagttggcagcaacgcagcaatgcctaagtggaataatcacttggacccgaatctgagttgttttctgtccccgacaacaaataatgttacttcagcgcctgcaggccaagagttgaaataagcttataatttggcttccaatccatctcacattctgattcccaaccacttaaattttcttttctgtgttttagcttgcaggcagcagatctggaggctccatcactggcatggtctttatggatatccttcatgaatacccttggccatctaagtaaaaaggggggaaatctacataatccaaaaccacacttgttttaacaatgaaaacaaatagactgtcagctggtacctccacataatcattaataatctaatttgtactttcttactccagcaacttgaagaactgttcacagttttctcatctacacacagtaacatacatcgagccctggagtgtgtggtactagcaataccaaactgcaggttcggagccacggcatggctcagctcctccctctttttccagtgaaggtacttattaaaagtctgctcttcagctctggaaagtacatgtctccttagccgttccaagcatcatattcctccagagaagagtcatctcaagctagtaactgaaaaatgaagagactagaaggcaaacccactgccaagacccccttggtaatcagggtggaaggggaatagcatcttggaaaattccaggaggtgacctgcaggtatactaccagctaatgagaagtgggtatgttcaactggacagacgctctataggaagaaaagagaaggaacatcaacagcacatccataatgtgtccatacaccacacaagctatgttacacatgaactcattccaaccacaacaatgctatggatatgtgcattaatatttccactttacaaacacagaaatgaggctcaaaggtgttaagtaacctactaggctcatacgtggtgaagtcaggatctttctaactttcaaaaccaaactctacaaaggaaagcgagcctttgctctgttgactttgcaacacaccttcacctacaggacttagccttcatgtatgattctttgaaattaagtatggggcggccaggtacggtggctcatgcgtgtaatcccagcactttgggaggccgaggcgggcagatcacaatgtcaggagatcaagaccatcctggctaacacagtgaaaccccgtctctactttaaaaaaaaaaaaaaaaaaaattagccgcgcacgatggcaggtgcctgtagtctcagctactcaggaggttgaggcgggagaatggcatgaacccgggaggcggagcttgcagtgagccaagatcgcgccactgccctccagcctgggcgacagagcaagactctgtctcaaaaaaaaaaaaaaaaaaaagtaagtatggggcttacataacacagctgcatggaagtggtagctaggtatatgtgctgccagcaacctaaggctgccatgttggcctcaggaacacagcccaccctgatcccctataattccctcataagaaaccataatgacaaaaactcacactttctgaatgtcaaagaaatagacaataagtatttgccaaaagcaaaaactaaatccaggaaagcgactgcagttagaatagttacaaaaccttgctttgcccaattcagacagtgacaatgacatccctctgtctaaattcttatgtcagcctggccaacatggtgaaaccccgtctcaactaaaaatacaaaaattagccgggcatggtggcaggcacctgtaatcccagctactcaggagactgaggcatgagaatgactggaatctaggaggtggaggtcgcagtgagctgagacggtgccactgcactccagcctgggggagagagtgagactctgtctccaataaataaataattaataaattcattcattcactcgttcttgtatccgggtctcagtcccctcccctgtcctccaatgcctagtatgttctccatagcttggcacagagagtgaggattccgagtgagcattatggaagagctcatgtgtcatcaccagtgtcagttacagtaagaaccgagtaagaggaggcaggatgtgcgtgagagcggctgagaaaccatccatggaaaaatcctagacttggttttgcaagtttttcagttgggactctaaagattgggaagtccacccttccccacccccaaagaaatggagtttggcagacatcaattagcagtcctctataaataaacctgcttttaatcatgttaaaagaagcctaccaaaaatcatctactgaaaagagcaattaaaaatggtgaaaatgagtacattgagatcaataatattttaaccatctaggaattcatcctatttaatgtacaactaataagtgaaagttctccacattttaatgtccaaagggcttcaaaaacacaatggacccaatggtgtgaaaatatccatccagctgccttaagttccaaggcttactcacctgcatctatttaaaactttaaatctttagaccatctaaaccatgtctgtgtcagacacactgattctcaaaatgtgaaaaataaaaaggctaaaaaccctcttcaccatcagcatgcctaaaataacaaatgaaaaacaccacgagatgagatatgtgtctgccaactagaagttcccagtgagatcttctttgtgcatatgtggctaattttatatatacacaaaatttatatttaaatcttaatggtaacttttttatttctttaaatcagtgaagtcccttatgttatggcactggaggatagagcagggatagggtcaggaactatacagacaacttctaaaattatcatctttctcaagatatgtctcagaaaagaaaggcctcttggatgtcacacatgataaattgtgtgttactatacaatatccttaaccacattccttctacattaaataattttactgcaaatagtatgttttagaacacaactgattttaaaggtcatgagttcttcccctaaaagattacttttctgttattttgtcaaatgaaaaagaggatcttggtgtcctggtcttaagactacaggatgcagactcaacggaaacatatctatttttaattcctttttcattttaatcctttcactcaagtgggtcaccctgcttttcttcacttcaatttcttacctcaataaatagagataatctcagataacaaaattatgctactaaattacttga

SEQ ID NO: 471 - DNA, 8000 bp, Homo sapiens
  Locus number 83 genomic DNA region, claudin-18
taagaaggaagtatgccaaatattttgtctagggcttaaaattgtgagcaatttgttcaaattctctccaaattttctattatgaacaccaaaaggtgaaattaaaaattagggatatatgtggtaatatttttgaagaaaaaattaatagatgtgtcaattatttttctcactagtatattcattttatttcttcctaattcctagctataatattttctattgttatttatgccaccatttttgcctaattaccatagacagtgttataaaaagtggtggaaatgttttctccaatggcagtaaaataatataagctcttggaaacttacaacctgaaatgacactgccagggccgtatttaaacctgaatgcagggatgatttcccctaggaagtcagcaaaaattcagctccattttaaaggtgattaaacaaagtttaccaaccccattattgttaaacagaatcagacctggacttatctggtagagatacattgatatgtttcaataaagcctattgccataaatgagaaagtcatattttcctctgcagacccccattcattttttggcagatacggctaaaatagtagtctgctcagagcccagaaaacttaccaggaagtgaaaaatcctatcttccaggtgttttaaaacacatcagtatttatttcacacagaagaagtgtgtagatttacaatttcactcctctcattcagtattctgcctaggtagagatagtcttagtttatcctttaaaattaactttttctattttcaaaaaagtgtcactgtcaccatttcagccaagaaagaaaatttaattccttattatctgaataacatttttccctattttgaaactctgcatgaaaacatttgcatagggaaactggggggggaattgccatagatgaaaaatagataactttaatcaacaatttttttatttttccatcttcaatctatgtttttggtggtattctaacacatgtatatgtattgtcgggggaaggttagacaaatgtcataaattgaacatctgaaaatcaaaccaatagagctttttaagaataaaaggatacaatttgacctagcaatcccattactgggtatatacccaaaggaatataaaccattctactataaaagcacatgcacacatatgtttattgcagcacgatttataatagcagagatgtggaaccaacccaaatgcccatcaatgatagactggataaaatgtggtacatatacaccatagaatactatgcagccataaaaaggaatgagatcatatcctttgcaggaacatggatgaagctagaagccatcatcctcagcaaactaacacagaaacagaaaactatacaccacatgttctcactcataagtgggagctgaacaatgagaacacatggacacagggaggggaacaacatatactggggcctgtcgggggtcgggggggtgaggggagggaacctagatgatgggtcaataggtgcagcaaaccaccatggcacatgtatacctatgtaacaaacctgcacgttctgcacatgtatcctagaacttaaagtaaaataaattttttaaatgaaataaatttttaaaatgaggattaaaaagcctgcctgttggttgaaataaaagtaagatagactctgtctatggaaacagtggtagaatcattcctgaattattccaacaacagttttcaacctaattggtcaatctatgcccaccagcagaaaccagtgtcacttctaactgttcccttccctccttttagaattggccttgtaacaactcaagggacacactgccatcaacattccttcactgtagatcatgtaactgttgcttaccctcttattttaggctttctggctcatgcttcactagaaacactgatcacagaacctaaagtaaggtgtgcagtgaaggggagtgttgcctccattcaaattagaggtagttcttccctatttgctttctgtgtttgctgggaataatgcagtgggagcagaggctgggtgcacccaagataacaaaatgtccagacacagaggctcgtttcctggagaacctgtaaagacctataaaggttaaagattggagtatgtatgtggggggggagtgtgggggtgtgtgggggtgtgtgtgggtgtgtgtgtatgtttcagggccttgaggtccagattttggagagtgtcattaaaatgtctccggagggctgggcacagtggctcacgcctgcaatcctggcactttgggaggccgaggcaggcagatcatttgaggtcaggagttcgaggccagcctgaccaacatggtgaaaccccatctctactaaaatacaaaaattagctgggtgtggtggcaggcgcctgtaatctcagctagtcaggaggctgaggcaggagaatcgcttgaacccaggaggtggaggttgcagtgagccaagattgcgccactgcactccagcctgggcgacagagtgagactccctctcaaaataaataaataaataaataaaaacaaaatatatctggaagccaggcacagtgagtcacgcctgtaatcccagcactttgggaagccaagataagcagatcacttgagctcaggaattcgagcccagcgtaagcaacatggtgaaaccctgtctctactaaaaacataaaaattagccgggtgtggtggtatgcatgtatagttccaaatactctggaggctgaggcatgagaattgcttgaacccaggaggcagaatttgcagtgaccccgatgacaacactgcactccagtctgggcaacagagcaagactccatctcaaaaaatttttaaaaagtctctggattcagaggccagacatacctggcccccatatccgtcaaccaattctctagcaaaatttagttgtatagacaaaacataacacctgatgtcttcagccaagtctctctactgtgattatacaattcctaatattttgaccaattctagtgaaaacttttctgcaaaatgtagaagatagtgtatgagatctgaaaaggctctggagtgttctagtttagatctcacatgttgtggatgaagaacctgtgacctacaagggcttaggagtttgcccccaacctgcccagcacacgacaagttaggggcagcatcaggagcagatcctaagcctctccgtgaccaggccaaggacttcagcccagctaaccctggtccctcctctggcctttgtgggacctcctgtgtcagccacagagtcctcatgtggttcttgtggcacgagtgaaagcatgacatggaaatcaacggggtccctggcttcctctcatcccagttccaatgcttatggaccaagagcatagatctaggatttggcttcgtgttctcaaaagtggggacaattttgcctgcccctgctgctccatatggaaacagagaaagagcgctggactggaagctgaggtgggagccccacccctgccgtttttagagtatctgtggttccaggcactgggacaagtcccttaacttatctgtacttttcttgactcacccccaaaaaatggggataatagtgcctgccctacccatttctgtaagatcaaaatggaaagatgtaagtgaaaaaagtcgttcatgagttgtgaggagaaaatgtgaaaagtctggtttaagacagagcacggtgggtgcttcccaggggccatcttaagcgaggtcagccaaagtggtctgcagtcacgttccccgtggtggggacacgtcagccttttctccagatggcggcgctctccggaggagccggagctggagggaggccggtctggcccggagcagggagtccttctgctccctggcacggctctgcgctgaacccacccggcctgcggagagcagacaagtgcctcttgggcccgcttctctaacaaatgtaaaaataatgcccttgaaccaggagcgaaactgagctatctaaggaaaacactgtgagcaaatactgagagcctagggaaaccatctgattagaagagctcccctcaggagcgcgttagcttcacaccttcggcagcaggagggcggcagcttctcgcaggcggcagggcgggcggccaggatcatgtccaccaccacatgccaagtggtggcgttcctcctgtccatcctggggctggccggctgcatcgcggccaccgggatggacatgtggagcacccaggacctgtacgacaaccccgtcacctccgtgttccagtacgaagggctctggaggagctgcgtgaggcagagttcaggcttcaccgaatgcaggccctatttcaccatcctgggacttccaggtaggcaccgtgcaccccggggtagagccaggtgaaccaggtgagcagggaagggggcgtttgcgttaagccccactcccacctctgggtgaggaccctggcagctctggctcagaatgaaaggtgtgaataaaaggagaagctggctcgtgtctaatagggcaacagtcatgcaggagaaaatgggagggttaatactcaaggcgaaggaatcgctagtgaggaggcaggcctcaagaagaatgggtctattgtaagggtatgttcatgatacctggaataaactcgtgtttctcaaggagaaaataaattgtgtgcattacttgcatgtggcttgctcctgcctgcacatacatgggagcagggaagcaggatgctgagtattttgttatatctggaaaagtttattgagagctaatttaattttctttccatttcaattaaatttttcaaagttggagtctctgtgggtgccaaaaagaatattgccattaaattataaatatccttttgctgcatttgtattaagaatatcttgtatactgtcctaaaaatcaatgtatatcaaaatataattacagaattataattatattatgtcagaatataaatataattataaatgtgacatcctttcacccctaaagatgaaataaattaaacccctgcttttaatatagataattacttcaaatatgcatcatagcaactttgcattctgaataatatgggagctctatttgtatttttaaaatgcaaacaagaaaataatagctctagctaattagtggctctaaggggtggccaagatgtgagtgtgatggagaaaggagaacaatgtctctgaaacaaataccttttataaacaagtagatggaaataaatttgcaagaaattgtgaagaggctgtagagcccttgaaactgaattgaattgtgaaaagcaattcaactaatccaagttcattttcagaaagaaatagaagatgggtgtcagagtagaagaatttgattatttattccattttttggaagccacttattgcaggaccaacaggatgactgactccggggaaagacctgcttagggaagcaagggaggtagaacctggccaaaagaaagagaaccagactgaggagggattatgctgtagtgggaggggagaggtgagatgcaggaaatgccacacagagtgttgagttgctagttatgtctaattttaactatcatataaagaaaaaatattgtcctcatattcaaaattaaggcatgatgtcttatgacttcatgttcaataacctctccccagggccccactacatattatcaatctcttgctcactgtgtatcacagtctccatacatggggctcctgaatattcccactctcctaaatgggcaaaccccattgcgtccactgtgacttgtcactcctattctgtcaacggatcttatctccatgacaccctctcagaatagctccacctctcccccttgatggaacaagattatcttccctgctttcctgctaaggtcaacctctcctgctaaggtcaacctccccagcagggctctgaaggcctcatgccacctgtctgggatcatgccctgttggtcagcccctctcctccttgcctctttcatctcttctcctcacttatgcatatggcctccttcctggggaaatctgttgatcctgatcattgtcaagttctgtctctctcctgggtcactgacaaaccaaattaaaagactaagtttttccactacctctcacccttaacctttctcagtctggtttctatccttcatctctatagaatgtttgcttttttgaccatagcagaggatgaaggggagtatttcagtcaccaactcctagttctcagttctcatctccttagacatttcaaaacccaaacaacttccacggttccccattcccagcttaactaggtgcacacataacagcctgacaccaagccttcctaacccctcacctaccttccttggcagtctcttactcccccatcctgtttcttctgtcctttcagtataccttggacttggtcctggacatccattgctcctgctcccctgaattcccccctccaccaccccaactgtcctctcacaaatcttcctccaaacctcctcaagcccccaaattgaataaagattccacaagtctctgtaccaaacccagagcattctcatagcattgagcatattcaccccgcgtgacactgctctcaaatctgagaagcatttattgcatacctacaaagagtacacaacacaaaactggccttgtcggcaccgtaaattccagcagaggggacaggcatgtgtgtgaatatcaaagcaaaggcaacacatgtcatggggctttgacacaagtgtttggagcccaggaagaaagtggttattcagtaggaagagtcaggaggggaggaaatcaggacagttttgctaagggagttctgtttgagtctgaactttagcttactaacttggttatttgtacatttgtgtcattcagcttctatgtggtgtttcccttcagctggataagaattatttccccatttcccagaaaagcgcctggtagagtgagtatttagcaaaggattgataaactaagttgaattaaatagtacgaatagttcattttaagtgtttatgcaagccattgaactaaaaacaggttaaggtcttccccaaaaaggacagtaaatcatttttgtactataaattttttgttattatggctccatatatagaaaaggacctggtcctcctcctgcctggaacagattcatttgttcatccaatcatgtatttaacaaatatctcttgcatgcctactgtgttgcagagactagagttcaggaactctattagtcagagtagttaatgtctgctgctgcaacaaacaaacctaaacatctcaatggcttgacacaacaaaagtttacttcctgcccacataaagtccactgtgggaagagcagcctccttgtagctacactcttcaaagttgctggggcaagagaagaaaggcttgaaggaggcacaacagttcttaactgcttcaatctgaaaggaacacatgtcactcacagtgcgttggccacaactagccatatggccccaggagctgggagatgtaggagcacatagctattgggtgagcacctactgtctctaccacagggagcatttgagtagtaacttcctgggctgcaacacatcaaccacactaatttcagttctgccagacagataattccctgaacatcaaatagtcaaaaccaatgagattgcaaaagaagatataccattaatttatatttaaacaaatatgatagaattatatgtgtaaactatcatctgacacaagataatatatagcgtgtaatttcagagctagacattttggtggggatggcctggaatcaggaaagaggaggggtttaaggtaaatttctgcaatgtaaaaattccctaacatttaataacagaggaatgtaaatatggccatgggggtgggggcggaaagcacatttttttcaaaaagtaaggaggaagaaaggaacagtgggtgagggagagagggagggaaggtgagaag

SEQ ID NO: 472 - DNA, 8000 bp, Homo sapiens
  Locus number 84 genomic DNA region, growth hormone secretagogue receptor type 1 (GHS-R), GH-releasing peptide receptor (GHRP), ghrelin receptor
gaatggggttgatggcagcactgaggtagaagaggacaaaggacacgaggttgcagtactggctgatctgagcaatctccaaggagccaggctcaaaggatttggaaaataaatatcgccctacgtggaaggggagccagcagaggatgaaggcaaacaccactacagctaaaaggacaatgggagagagatagtcagctcaagaaatgtcacagcaaatcacattctatttttaagactttgtttttgtttcatggtctatgaccattgacttcagagaaacattgtgtcctgctcttcctgttccaacattttaacaaagattcagtctgtctggaccaacagttcaacaatttttactgagctccccagtcatttctatttaacaactatctgagtgattttgtactgagttgacacattgactcaactgactagaccatttattcacaatagtccagcagtttttatgtgttagacacaacagacacacttacgaggtaaagtggttgtactcaaccatagctgtgtatccgagtctcctggggcactttttaaaacaatgcagattccttggatgtagtatagactcagtcaatttaaatctctaagagggcgatcaggacatatgttttatcttctcttttttttttttaagtttcacagaggattgaatatacagttaggattaagaatcactgagatgaatgattctatgccacttacaatagacataagtaaggctattattaaaccaactcatataaattatcatccatccaagtcttcattttgcctatgtaagataatttttaatgatgtctaaatgtttagattgttttaaattcagaaatcagggaaaaataataacaaataattttttagtcgttgtaacactttagtgatccccttcaaattgtcaaggaagaagaaagttaacattggtgttgagacaccaatgaagaaattaatggcttgaaaataaaattggaggaaattattaaacttatccttaaaactaagttgtatagtagcaacttaactgccacagtaacaatgtgactctcgtaggtgagagcttaggatcccttggaggacactagcaggtttataacctatgagtcatatcacgagaatcaccggtccagaaaataaaatctttgacattccttgaataaactctatcactttaatatggaggatccaggaactgtaaaattggaaatatgaaatcatcctggaatggcttctaagaagccttaaaatatgccattaagtatgaagtcttgactataatatctaaataataaaatatacagaccttggttttgaaaatgcaagtagagttaatattttgctgggctgtaaccatatttattattacttcacttgtaccaaacacatatacttaaagaagctgaatttgtgcaataaacattcagcaaatccagttatgacattgtgcccagatgttcctgaagggtcatttggggaagtagtgaattctgttggtttccacaaagtctcctttcctcctgttggagctttgtttaatctagtttatccttaccttatcctagtctatcctacctgaagaggcaggtaatcataaaaacaaatgagacttcactgatttgtcactgacttccttacaaagctgtatgaacagcagcagggtaaacagaattgatgcaattatctgaaaaaatgcagggcagaaaacaaatcacaatattgaaagaaaaatgaataatctctaagaggattatccaaattgatcatgtctttggttgaatttaccgctgaacgctttctagatccaaaccctgcttttcttaatgtaacttagatattcacaaatcctacttgaggcaggaagtcagtcctcacttttaacgcttaaagaccacaatggacttttataagatatctcgatttttaaagtggagtttctgggctgatataaaatttattttagggaaatacaaatatgggacatttttgcatgaaagagagaaaggagagacaggaagaaagagacacaaagagatagagacggtaagaaagacactgacaaagtaaagggggaggagagagagagacagagacagagagaaagattgagagatcaaaaacatcactcaagaaagcaagaggagagaataattgagagaaacgcagagagacagaggcccagagaaactgaagaaagaggtagcgactcagggggaaatagagatggagactcagagagaagggagaaggcacagggagaggataggacccgcgagagaaagcctgagcgcgcgctgagacccacccagcattttcacggtttgcttgtggttctggtccctgagcgaggcacccacgacagcatcgccgcgcctcctccgccacagcttcctgccgatgagactgtagaggaccgtgagacagaagacaggaaggaagaagaagatgctggacacccacaccatgaccgtgagcagtccagagcgcaccgcaaactcggtggggcggcactcgttggtgtcccaagggtcggtgccgttctcgtgctccaccccgactagcacgaagatgggcccggcgctgcagaaggccacggcccagatgacgaagatgaccagcttcacccgccccttggtgaccaccaccttggcccggagtgggaagcagatggcgaagtagcgctcgacgctcagcgctgtgatggtgagcaccgtggcgtaggtgcagctctcactgacgaattggaagagtttgcagaggaggtcgccgaagttccagggccggtactgccagaggcgaacgaggtccaggggcatgcagaggaagatgagcagatcggagaaggccatgctggacaggtagaggttggtggtggtgcgcagctcgcggaagcgcgacaccaccagcatggtgagcaggttgccagcgatgcccaccacgaagagtgccacgcaggtggctgtgacgcccgccagcagcggcgcggggaagagctgcagcagctcgtcgcccagcgagtcgttgccgggggaagcatcccagtccaggtcggccagtgtgaggttgaaccccggctcttcgctgggcgtcgcgttccacatgctgccggctcagctgaacaggctctgggacgtgactgcgctgggaggctggaccgagctggctcccgaggaggtccgcttaggcgcgggagggtgcgagggaggagcgggtgcagacgcgtagggaggatgcttggagaagaaagagagggaggtgagaggcagaagccgaggaagaaggtgagatggggacaaggaagagggagagagactggtggtcagtgggtgagagagtgacccactgctttctctgacacctcccctttcccccaccaactcccccaaagtttctcccaacacatcctccggccggcgcccacacgcatacctgtcaccagccctgcctcgcatttgcgttctcgatccagttccatctcgcacttcccaaagcgtcgcagcgagtggggaccgcagggaccaggcgccgcgaagcgggagcgtgaggcgctctctccgaagccctgggcgacgctggactagtgtgccccggaaggacaggtcacacccgggggtgggggtgaagacgacggtggcggtggggaggacacctttagcagctgggacctgatttcttcctccacaaggctgcagctggctatggccctggtggaaagaaaaagcgagcttgaccaactcgacttgggaagggggatagagagagaaaagaaggaccttgtgtttgtattcataccggtgagcaccaaagaatagtctcacgcagttataggacccaggttcagcgatgtgactacttgtccaaggtcacacagcgagctggggactcggggaccagtgtcggatctcccacccggttgggacttctgagcgcacaggggcaagatatgtgagtaaaccctgtccagaatcccagtcctttgtatcactcggtagtggtagagagtctgctgtagggtatattacttttgcttgatgcaaacctggtggcggggtgccgaggttggtcagggagggaacaggagaaaggaaaaaggcagggttggaggtgtgtggaggcggcaagtgaagaagaggctgtgaggctggcgcgtcgagagtgtgcaggaaacattttttgaggcataactgagagagatcagccatttagtagccgtattcccttgggcaaggtcttcaacctcctgagcattacgtctttttctttgaattgcaatgatttgtgcggaccactgggggtgatatcaagtgtcagggaccaccggaggcactcaataaatagaagacgcgttgctgttgagaagtagaagctgtgccggtgggaacaggtcaaaggccacccctacactagcaaggtgaccctctggacgcggtctgtgcgtctcctgctcagagccagaaatcagcacccgaaggcatgagactgccagttgccagcgaattcacaaatccgaccggcccctcccggcccaccgacctcgggaccgccccaggaacatattcagcactgtggccagcgccacatccatcctaccgcaaagcgccgctggaggaatggcttccctgtcactcccaccgtttttaacttgcgcttctaacgcctcagtcctaccccacggaggagcagggcagactcccacgaagcacaggccggcgttagtcactgccttgaccatacacatcggcgctcacccgatgagataccacgtactgtgtatgagagagtatccccctcagttgaatgcgtttgtacttgcctttcacagacagtttgtaccacctctactacctaaattgttaatacttaaaagtccacaaagacctaagactgaatgtgtgcacaaatgcgtgaaagactccatgcagtaaattactacatgagagaagtttgatacaggaaatttaacatagtggtttggttgccgctggtgtgttagacattggaccaaactgagttttgtttcgttttgctttgttttgttttgttttgctggttttgttttgttttgttttgagacggagtctccctctgtcgcccaggctggagtgcagtggcgcgatctctgctcactgcaacctccgcctcccagtattggatctcccacccgtttggacttctgagcgcataagtccaggttcaagcaactcttctgcctcagtctctctagtagctgggactacaggcgtgtgccaccacgcctggataatttttttttgtatttttagaagagacagggtttcaccatactggccagtcttgtctcgaactcctgacctcgtgatctgcccgcctcggtctcccaaagtgctgggattacagccgtgagccactgtgcccggccccaaattgagtttttaaaacattaatttcagactactattttttaagtattacaactaagtcaaactaccaattacaaacaagtttttatttaatcaataactttgttactccctgacctatattatcagtaggttgatgtatgtggaaagaaagggagagaaagtggactgggataaatcagaatactatgggaagttattgcctaagactgagaatcaggaaaatattgttggatatatttctagtctactcagtgctaaagctatggctgatagttgaaaaaactgaaaacaaaaaccaccaaaactattgtgataaaaaaaattttcatgttagctaaaatagccagccatttaatggcactcaaccagtttctaaaatatagacaaatctatattgcatgaccaagaagaaacagagggtgctattgtagttgctctatttattcacaacatgtgaaatattatgtaataccgtatataaaactatctctagtaagtggtaggtactaggataacaaaataaataaaacccagacagatcctatatttataaacttatagtctagagagaaaaatacagttaaataagtaatgctagtacagtattgataggtgcatttaaagaggcatgtacaatgagccctgttggaattcagagaatgaatgaaccacgtggaggctttagggaaggcctctcagaggaagcagcatctgagctggatcttggaaaagttcagttccatcagaaaaaggaaaacttgctcaaccattcagacaacggacacaaaagcattttggagtgacattcagtatgccttgttctatgaatggtgtaaagagtattattattgacttgtggatttttatatagtaagtgcataccaatcagttacggcgattgttttcttttagacactcaaattgtcccatctttggccaatgagatccacttcaagttggttccagggtccttttgacataactcacttagatttttagagcttacatgctgtgttttgtggcacaatgagatgcctcaagctcaccttgtaaattctccacactatacctaggagcaaccattatttcaagaatccctggtatccgcagtgggaaacagcatttagagaccaacatttgggcagtggggttggttattatccctggagcattatggtctaggttctgcagacaaaggtaggatatatacatatgtatacacattatatgtatattctatacatataaataaagttacatagtttccattatgaagatgtaccttagtttcatttaaccagtttattgataaatatttgtgagtttttaataatcttttattgctataatatatatattgctatatattctatacatatatatggtgtgtatatatataggctatgtactatatacatatatatacacatatatagatgagtgtgtgtataatcattatcatctcacaatatctagatatctataaatcatgagatgataattatgatactgtagataaatcagacagaccctgagcagatgaacaaaactaacatcaccactatgataccctgggaaggacacaatgtcacttatatgcattccagctagaaacgaagaacctcaatctaatcacaaggaaacatcagacaaactcaaaatgaggaatcatttatttaaaaaattattccaaaaatttcaatgttacataagacaaaggaagactgagaaaatgttccagaacaaatgacaccaaagagacataacaactaaatgtaatttctaattttaatttctgatcaatgttcggtttattgaagttgacagctacatggaagaggatgttcttattcttagagatgcacactcaactgtgatttatgcagcttactctcaattgtttcaaaaaaatcatgtgtgtgtgtgtgtgtgtgtgtgtgtgtgtgtgtgtagatagagcaaatgaggaagcaaatggggcaaaatgttaataacaggtaaatcttacgaaacggtaaaatgattttctttgcactataattgcacattttctataagtttaaaattactttcaaattaaagttcaaaactcatacatttgtatagatatttctgattcaatttccaattattaacttctttgagttgatatttatactgaacatcttgtttctaacaacataaacataattatcttatacataaaatgatttcagactaataacgtcagcattaccactaataataaaattgacaaatgaagtttgagatgtttttgcagttctcttttgtccttacagtatatcccactaagtttgtacaattgctgtattttcaaattacttgaaacaatgtttttctatgtgtggttatttaccaatttgatacatggttcatttgtttccattactttcaatttttaaattttctatttatttttaaattttaaatttgctttaaaattttagtttttaatatataaaacattttcttgatctaacaattaaaatgttaaagtatggttctaaatttaaaactttaaacaaaagtatacccaggaaaatgttattttcttttcctact

SEQ ID NO: 473 - DNA, 8000 bp, Homo sapiens
  Locus number 85 genomic DNA region, endomucin precursor, endomucin-2, gastric cancer antigen Ga34
tcccttcctctagaacctcttgattttcaagcttcaaagcttataataatttccacttttatatgtagccgtttcagatgtccttacatccaaaaccaggctagttgtaaattttctatgtcattctttatttacctcttaaagcctacaatatagccaaattgataataacttccctcatcttcctctctcccccacttctacggtgagggttaacttttattaagttctataaacttacgatatttagcatggagtctgctgatagtgtgtttaatctttctttttcatgaaattgaatgttcaatcactaacaaaggaatttctccaagcaattaaatccttcttcatataccaataaagaaaatggtgtttgtccctgtctgagaatgcctacaacattttaatatttcccaagttaaggcaaatttcaaaaagcaagtggcacttgatgagtaagtgcatattgtttccttcttcttggaggaatctctcttcattaacttctctcagccctgaaagtcaaaagctcatccatacatctagatttaaacgccagggtaggggtctgttcagttttaaatacaatttagaaaaccttaagaaagaatggcagttccgtttcagaaaccttccatacacatttcaatagaacagctttccaaattggagactgaaaaaatattataccaccaaccaagtaataaaaagtaactcactgactgtgatgtagaaagattcccttgattttcacaaacagcatgaaagactgtattgtagttatttaaatctgagactgacaaaaacatcagaagaaaagaaaagtagtcaatttatctaaaagataattatttaggaataaattactacgcaaaagagcatggatctgcttgacagcttgtgaatttaaggcagatgaaatgcctccctcctcacccccaagaatcaactttgctgatgaaatatgttaatcattcctaagtttgaggaacatgtaaaactctgaaatcaaatgtgtatctggaactaggggttaaggaaaaataaaggtactcagtcagcttaggaaatgctttcttccctgtgcccaatctgcaaaaacaaacaaacaaacaaacaaacaaaaaaacaggcagaaccaggtacaacaaaatcatacatgtagatgggaaattatcttccaatcctttcatgctccactcaaatggtcaatttatactcttgagcatagcctcctctctaagacaaatggagtaggtttggtttgtttgtttgtttacagatactggccttcagttaacaagtagacttgttggctgacttgaaggagatagttattatgtaactattgtctctgctcaaatggaaattatcctacaggggttaacagttcattagaaagaagaactgttaacaggttgagctcattaccagtgagcaaaaggaggtttgtattttcccaaaatgaccataacagaaaaacctgccagtacatctctggattgtccttcatcttcatgtctttcttaaggccaggtattgcaggctacttctattgatgctattccactttactttcggaagaacgaatgatctattcagagtttaacaatgccggcaaagtattgcactcgtcgatgcttgcagacctggagcagcgagcaggctaagccagactttcagactttatactaatctgacacatctaattgtgagcaatattttccatgggattgagattcctatcaatcttccccaagcagaccgaagttacttataagctaatgcaataatttctgtggtaccacataaatgttctttattttaaaaaatcagattctagtaactcttctaagtgaaattttctggccttgataccagctgcaacttaaccgcagaaactccaagatgcatgatgagcaaatgtgcgtgaatttgaagtgtttttgaatttgtactaaatttacatagatatttacatagaaatgactgataaaatgttgttcagggagggatgtacttattttcttccgacattatcactgtaaattaagattttgtaggcagtaatcttttaaattgagaatgagcaaaataaaattagaaatgaatgtttttgtttttttccccccaagacccctcagagtctgaatcagtctttcccaattgtgttcttttatggtagtttgttcttcaattttcacacttattaaatctattttatattaaaatcacatgcttatttctcccagtagtacttctaccactttgggcaaggacgtcttacttgtttttatattccttgcagtacagggtaggaacctaataaatattgattaaatttaacagtttattttcaatcactcaggaagggttaaaagtcaaatgtaaatcgttcttgaaattgtccattgatatactcaaggcttatgaagatacaaacctattttttatctgagtttcttaaccagaagtcaataggtaggatttttatgtttataaattcctgaaatgttatgcaaaatgtatgtatatgtttagatatgtgcatatttcttcagcaaaaatctatagactgtaatcaaatgaatctctctctattcaccctacctcaaaatattaggactcacttccctaggcagctttactcaactcctcaatttatcagagctgaaaaatagttgggaaaaatacaggctaacatctgcaatataatgtctccgattacagcctttcacccacacatgccaatcttattatttctgagctatgtctgcaaagaatacatttttgagagagagtacatttttaaccagcattctattcccagatttttatactctaaagaggccattgtatatttccagtactttgtgatttcatcgaacatgctttcaggctgctgtacccgcaaacatttcccttcagtagaaacaaataccgtctctctcaagccttctccacgcactccaagtcaacatccaaacactcaactcatcaaaggaattgctgcatctaagtgtcaggggaagatccctgaaagtaaactgaggctgagtcacctactagtgatttccaatccgtaccaccagaggaataagagacaaaaatacctgtgctgttactgctgcaaatactgggcagaagaaaaagaatggtcacttgaagcagttccatggtgcccgtagatggtgtcaatatcttctttctccagaagcaggcagggacaattccctcccagcctggcagggccttattagcaaatggaaaaggtgtagtgaatgtgaatagccactgcccattcctacttattttgggggctctgataaagaacgggaggaaatacacacactccctttgggagttcagcagagaggagatttattgtttcagtcccttacaggaactctttttttttctctctcttcctttggcagccacttgtgtttttgttactacattattttgttcttcttcaacagaaaggtcgggactggttttgaacagaaacagatccttcttgagaatggatcatagggccttctaacttttgttttgaaagtgcattctgaagtggttataaaggggcctcatttagcagctactcagttgggataaagaggctttcactgcccgagggttaaattttagagcaaaatccatcaggaatcaacttaacttttctctttccaacttgaaagccagattagagaaggccaccttttggatataagtgaaaaattgtattaaatagattatgctctgctcttgagtaagcaaaaagacttccaaagggtgtacagagaagtttttcagtcttttttaatagaattaagcaaagacatgtgaatgtctattggtcactcctggtttttactaaagaactttgatgatgaataaggaacaattacttataacacctcatgaatgctcttctttaggggacagggttggaatggcagtgggtgaaatgccatcacacatcagtgaagctgggagaggttgactctttaagactggaatgccaaccaggctggataatctatatagcaggggtcacgttgatgtcagttgtgactgattaaaacgtggtgataacactgccatagtcctgggtacaagccccgtgtgtgccaatgacattatatttttcttcagccacaggcttcatgtctcattttagctgatcatccttttacgtacctttactcatgaggctttactggacaacattgtcaatgaatcggtgtagattcattttccccacaaaaaaaacaaacaaacaaaaaaacaaaaactgttcaaaaattatacctttacctgtttgcaagaagggcacacagtttcactgctgcaccatgctggaaaatacttcatacaaaacgagttagactgagtcaactgctcaaaacacttaaaaacgttagcttgttttatccaacgttataccaggggtcagaagagctaagtttctattttgtgcataagattgcattttaccctcttctaattgattttctaaaacagactgcctttggcgttgttactttatttggcatatcctggagaatataaagataggaacatatgtgaatagatgtcacatgcactttccataaataaattggggtgtggccatgtgaaatcacagtcgaaccctcacattgcctcacttcctgctccttctgtactcaagttgtcagtactcagagtcaccactgatgctggtcacaataatttcttcagggattccatggcatttggactcctcagcactaagtgctatgcatttccatttagtacactagatacctattctaagaatgcttgacagtagaatattaaggctacttaaaagacaaagggcctgttgatgaaaaacaaaaactaagaaacatcttaaaatgctagccaaaaaaaatttagaatataagaacagaaaagaaaaaaaaaaaaggagtaataatgaggggaggggtcagccttgctttactaaatcagaagatatttttaaggtaaaatatttaattaaaacagcaatgattgccagaggagacaaacagatcagtggcatagaatagaaagtacagacacagaaatatttatatttgtttctatctacataaatatacacgcagatatatttacagatatgtgtttgcatatgcatgcttgtgtgtatatgcatgtatatatagagagagagattaaatataggtgagtttaacatgtagtgactgtgatgaatagggtatatatttactgtgggatttttttgacaatgtgttaaccatctaagaaaattttaaaattaagtgtctgttttacttaaaataccaaatcttacatgttaatcttatatgttaaaggtttaagtttaaaatacaaagcacaaaattctaggagagaatatgggctactatatataattgaggtaaaggggacattttatgcatgacactaaaggcaaagcacataaaagaaagacttcatacatttgcttacacaaaaattaaaagatttttggcataacataccatgaatttaaaaggcaaataaaaaattttgtaacagtacatgataagttatcttaaaaaataacttctgatctaaaaagcaatgactctacaactgaaaaacggcaaaaaaatgtctcgcaagaaatggagggccagtaaaatccaaaactgtattcatcacaccagagaccaaagaaacgaatatcccaacatcgcaacaacgtgttttgccttttatatataattaggtatagtttatgacagtactcatttttgataaatgttcaaataaagtaactatcttattcttggggtatgacctttctgagatgtgactaggcaatatacatcaaaactgttaaagaaccacactctgagcttgcaaaattatatgtttaggaacttattctaaaaatgaagatattcattgaagtccatgtaattacaaaaatttgtcaaaacattaattattgaggaagaatattgttctgccacaaaatactaattagataacttttcatagatgtggaaatatattcatgacactttgttgcatgtatatatgcatatatatgcatatgcttatcatttatatatgtgaatgtacatgtatatatgtatatacatgtaaatgtgtatatatgtatatacatgtatatgtgtgtatatgtaaatacacatatacatacatacacatacagagcaagagagagtaagatacaaaatgttaatattgcttatcttctgaaatgaattatgggtagtttctgtcacatttttaaattttccatgaaaagatcttccagattaaacacatattgtttttacctcttaacaacaaaaacatttctcttgacctgatacattttgtttaatttaatgttttgagtgtatatttatacatatatttattaaacattttgtattctaacctgctggaatgttttcattattaggaagtgtataatttaaaagcactttaatagaagaaaatatgtgaagagaactgaaccactctaacctgagagatgaaaacatgtctttgctctttaatttgttgttgttgttgtttgtttctttttcacaattcatcttccgaattgcttgctgaaagaaaaagtagctgctaggaggtcatgcaagagcaatctcataattctttccaaatgcatatcaaggcctgtcattgacatctttgacactgaagaaattgtataatgaagactccaacactcatgatttatgttagcttatgtggcactgaaaagatttattcagatagcaccattactagggccccaaattaaactccctttccatacttgccttcttcctcttagccagctcattaccctgaataaaattatctaaaatgagaggaaagccaagaagtaatttcatgaactggcaaagagcatgatcttgagttcaaatcctgtctctgccttagttttatgtgacttactgagctatttggcccctctatgctgagctatttggcctctccatgcttagcttccccacagaaaaataggataaacatcatgccaactttctaatgtggtttagaggactaagtgagattccagaaagtcttctaaaagtacatattaaaacaaaacaaaacaaaaaacagaaaaaaacctactaaccttaaacttctagaatctttcagttgttaggattttatataaaccatcatattctagagtgattaagaaatgtcctaagaaatattcagatgatgagagtcccaaaatattggtttaaactgattatacagaatcccaactcttattatcaggaatttgttctatgctctacttcaaggtactttaaatatcaagtgctttcttcaatggagatgcaatcaaacagcttatttttgttacttgcctatttgaaatgggaattgggtgatctcctaaagattagtgggaacagagctgaaaccaaagagatatttagagcccatgattgtggagatattaagtctcccttcctcagggccaaaatggataatgaacatcaacagtgggagggcccagccatttggccaaacttatgccagtaaaatcactatctttctcacctaccacattcctattaatcaactcccagtgacccaggtccaatggtattttgttattgcttatgtgaaaagaaagcatcatagcaaattgattcttgaagtttctcaagagcttatctctcacattctccaactgtccatcccagttttactcctcagcatgtaaagatgattctcatacctcacatcaactccctaaccttgaataagtctcttgatatataaggacatgaatacagggaaattataaaaccacagtggctcagagatgagacatacgaaaagttaatttagtacgaatttgtcctaacacaggaacacccctgcaaatgctgagtgagcctccatgctaacagatgaaatgattgaggctcattactctgtcaggc

SEQ ID NO: 474 - DNA, 8000 bp, Homo sapiens
  Locus number 86 genomic DNA region, neuromedin K receptor (NKR), neurokinin B receptor (NK-3 receptor, NK-3R), tachykinin receptor 3
ttcattgagggaatatctgtcatttctcagagtcataagaggctgcaaccattttgctacagctgaacaaaagccatatgtgcccaagtcaaagttgcaattattttcaagatcacgggtcttttgattttaggcacaggaacaaagcgaattgaatatattttccatttaggctaggttgatataattcagtttatattcagtggggatagaaaacactcaaaattaaataattgaagttttcacacttcaattgtagtctaaattgggaaatatatactgtttactatattcttagctaaatgagtcagtaagtccatgcagaaggcaccatgattcagtgtcaacctcagaaaggttttctttaacttataaaatatatcctataaaatgatggaaaataccacatcattcaggtgtcaacctcagaagcgttttctttaacctataaaatgactgaaaacagcacagggtcagtttttacagttcatgtttgataagacaccaatgcagaaagattggtaaactattggactggtaatctattgagagttttaataattgttgtattttgtatactttttgattctaaaaactattttaaacaagatttctgtatttctgtttttttttaatcaactgtctgctcaaataagaacattcttttaaataataattttaaaagagattttcagtactcgaactgagtatgcttcagattttatagcatattgtatactctaaatttgttaatagttttaatgattaatgctttacacaaagaaatagtaaagattaatagtaaagtattcattaattcaaaccaatgactgtaataagatagcactaaatgattatttaaaataactccaagacaatcccataaatgttggcaggaagaaattggaaagagaaaaatacaacctttttttccccttcaaattgaaatacagatttcacatgcactaaaattttcttcaaagttcatattgcatgattaatctttcaagaagactgtaagaattttataacattatatgctaatacctctccccctaatcaaaacatcaaaaaacatatactataagaaataaaaagaaaaacaaacaaagcaaaacaagcaaggaagctgctcaaacaaaaggaacacttaacttctatcttggtgtagtaagattagaggcaatttcacttatttcccaactggagtctgatttttttttcattctttgcactcctatacatagtagtaatgaaggggtgcatatgtgtggataatcagagataaaggagaaagggaagattgacgattttagaggctttttaaaaagtgtgattttgtgtttatttattctagttagtggctactaacctctgctcctttaatttaatcctttgagcctggcacatgaaaatattttctagagatatatgttactaatacctcagtgctcagtatttcaaaatagtaaacacagaggatgaacttacagaaataacctgttttttcttatttttttattataatggcaactgaaatgtcataagaattaatatttatctccattttattttgatatgtttgttaatgtttaaaaataatctttgcatgaataagaacattgagacttcaagttaaagtgaaatcaccctcatgtatcccccatgcaactgcctttcacaaagctgagactgaaatcaactgctattgattttcaccacaaagttgaattaaagtgaagccagccttcaataacaggtagggattcaccattgtatttccacaaatacctatacttcataatgttcaatatgagaaggcaaaggcacatagagtttttaaaaatttggttacacacttgcagacacagggtttactcagttcatagcctctgcagattactggaaattaaatctaatctgagatgtggtggaaactgctagtttacagtagttttttggagagtgtgtgtggtctttgctagttcttggtgactgggagaccaaaccagtgttggccttggggcaagactagggaatagggaaggatgaggatgaggaacagacagaagagggaagggtggaggggcgactcatttaccatttctctgccagaatagtgactgacagagagaaggaaggccaaaaagtgcactttacagatgacataaattttgttcaaaagtcatttgagaaagtttgctggtacttaaacgtttctagctaagtttgccctacttggaagggcattttcacctgtccctcattcaccttcttcagtccctctagatatccttaataaggctcaatgatttagagcttgagtgttggaggccacggaagcagaaacttgttcagccactcgagggctacaaatgggttagtgtcctcctttcagcaaaaattcttagtctctttacttttatagaccccgttacgttactatttcctttgtaatcttatcccaccgcccagttcttttctttcccttctccctctttcctctctgtctgtcctctcctcacctgtccaccgcaatggccgtcatggagtagatgctggcgaacacagctgtgataggaaagaagttctggaagcggcagtagttggcgccaaagtaccactcgctatgaagcgcgtagatgaaattgaccaacgtgttgaaggcggccatggaggcgtcggagaaagccaggttcacaaggaagtagttggtgacagtcctcatgcgcttgtgggccaggatgatccagatgacgatgagatttcccaaaactgccactgccaccaccacaccatacgccagggaccagagcgcgatgcgccaggacggctgcacgaactggttggtgaggttggcccagggctgggagggcgcgggggaagccacaggcagtcccagcgcggaaggggaggaggagaggttgccagcttggtccagcagttgcagccacccagtctcaactgcccccgtggccgccccggcagctagcgaggcggtcaggttcacggcgtctgcacccacgcctccacccccgtctatccaggtttctgctgctgggagagtggccatcgccaccggtctgcagtcccggaccctcccactcacccacgggcagcccaagacgagactcctctgaagttcttctctgcctcctggtcactttggtgccggagtcttcagataagactggaagctgaaagatactgcaatccctgctggttaggggatgcagctggggctaaggggcaacagctgcactttctcagaggcgcttgcggctctggcaggcagaaagaatgagatcctcccgagattaagggttatcgagtcacatcacacgtagggagggtgccagctgcccggcacaggctggagaactgagcgtcctgcgctacaggctctctttatactcatggggtcccacgcttcggtgacgttgcaggggccgcggagctgactatccccttcgctggctgtgattgcactcgctccctccatcccgcccttcgcatttcattcattcgctgcaagcagctggagcttggcaagctgacccgcgcaagggagggctgcactccctcagctgtaattaaaatctttccaagattgtttgccttcttttaacttcaggatatcttgctgaggtccctgttctcaaacatgtattggggaccattccttcctgcacaaattaaccattcactcatgaggcaagggcaagatcctgttgatttttcggagagtgcatgagtgtagactgctgcaggctgtgggcacagtcagccgcaaacgtttttaggtgtccctgggttttgaatttcattcaacttttctgctctggtgtttatattctctcatctcagattccttttcctctcgctcccactttccatatccacccattttctctcttcctgtacctctatcactagaaatccgtccctctgaccccattcccagcaggcagctggagactctggattctcctggaggattctgctcaggttggaatgtcatagcacactaagggtaaatcgcaaatcccaaggagtacattttcttgaaacacgacaacgagacagatctctacatttccctgggttgaacgtagccagtaagcactgtgaatacacgctcttggttacagggttctggatatatggtgccttagttttcagggcttgaccatgaggacacactgatgagaataccgtaactgaacaaatacttgggttttccgggaagacaggcaggacctgatttctgagctttgcttgagaataagtgagctaaagtgctcggtggattgcaagctggaaggacatagtctgtgcttagaccaatctcaggaaatttagcaagaggttccagagccgaaactcctttgttagcatcctgggggcatgtgtataaatttagggttaaatatatatttagcaacctactggatatacgtgaactgtttgaacctctcttgtcatttaaaaatgagtttttaaagaaatctcatttacagtataattatatgatagtttctacagacttccctcaacaacagcaggccggaggaaacactcttccctctagttatcattgtgtattacatctaaacatgtttaggtgaaagggatttgatcaacaagtttaacaagagaaggtaacttgtgatttgtacatattctgctttttccttttctttttttttttttttttttcctagttctgtcacccaggctggaatgcagtggtgcaatcatagctcactgcagccttcaactcctggctcaagtgatccttccccacctcagcttcctgagtagctagtactacaggcatgtgccaccagtgccaccacacccagctaatttaaattttttgttgttgttgttgttgcgacatggtctggcgatgttgttcagcctggtctccaactcctggccttaagcaatcttcccagctcggcctcccaaaaggctggacctccagcaatgctgggattacaggcatgagccactgtgtctggcccttctgccttctttagttttccagtttaaaatatactcttcaaagaacctgctgtgatgattggacaagtggacttaaggtgtgtagtgataaatagtgttttccttcttacagttattatgactaaatggctagtgtataacaatgattttaagcaacctgatagttattatcacagccttgacacaatcctgcttcaaagtaaatgcatgcagaccatgatgattatcaaatgttatttcccttttcttctgagaggcctgtgaaaatatgtgataaatcataggcaaagtcaataagattagcactttctgcttactaattccaatggtttaatttaactattttcttttgaaagattacttctttgttctaattcatcatctagaaattgcttgttacaaatgaaagcctcttcctttcccaatgcaattagaaagacattaaaaatatatctccatatgacacacctgcttactcaaaattacaaaataggttatgtggtggtttggtaattaagcatgttttgatcagatttttgaagctgaaaaattacttagttgtgtagaaatacactcattttactgttgctttccttgtaatacttacaacaaacattttaatttttcagttttgccttcattgggcttatacaaagtagaggggatatgacaaggaaaaaaaggataatgatggaattagatataatgaaagaagtttaaaaatttattcctttcagaggaagggaggcattcagggcatggctttccttctcaatctgccttacctactgagaatctcccttgaccacaagagggatcagtgataattcattgtctatcatttcttagctatgtattagcatacttctttccaggtgctatgccagatactgggagtatagcaatgaagcagttatatatgaattctattcttgaagcctagagtctagcagtattttttcacattaagaaataggaaggaaaaaaaggatctgagaagtcctgagatgaaagtactttagccctctccctctccctctccctctccctctccccaccgtctccctctccccaccgtctccctctccctctctctccacggtctccctctgatgcccagccgaagctggactgtactgccaccatctcggctcactgcaacctccctacctgattctcctgcctcagcctgccgagtgcctgggattgcaggcacgcgccgccacgcctgactggttttcgtatttttttggtggagacggggtttcgctgtgttggccgggctggtctccagctcctaaccgtgagtgatctgccagcctcggcctcctgaggtgctgggattgcagacggagtctcactcactcagtgctcaatgttgcccaggctggagtgcagtggcgtgatctcggctagctacaacctccacctcccagccgcctgccttggcctcccaaagtgccgagaatgtagcctctgcccggccgccaccccatctgggaagtgaggagtgtctctgcctggccgcccatcgtctgggatgtgaggagcccctctgccctgccgcccagtctgggaagtgaggagcgcctcttcccggccgccatcccgtctaggaagtgaggagcgtctctgcccagctgcccatcgtctgagatgcggggagcgcctctgccccgccgccccctctgggatgtgaggagcctctctgcctggccgccccgtctgagaagtgaagagccccctccgcccaggagccaccccgtccgggagggaggtggggggcagcccccgcccggccagccgccccgtccgggaggtggggggcacctccgcccggctgccctgtctgggaagtgaggagcctctctgcccggcagccaccccgtctgggaggtgtacccaacagctcattgagaacgggccatgatgacgatggcggttttgtcgaatagaaaagggggaaatgtggggaaaagatagagaaatcagattgttgctgtgtctgtgtagagggaagtagacgtaggagactccattttgttctgtactaagaaaaattcttctgccttgggatgctgttaatctataaccttacccccaaccccgtgctctctgaaacatgtgctgtgtccactcagggttaaatggattaagggcggtgcaagatgtcctttgttaaacagatgcttgaaggcagcatgctctataagagtcatcaccactccctaatctcaagtacccagggacacaaacactgcagaaagccacagggtcctctgcctaggaaaaccagagacccttgttcacatgtttatctgctgaccttccctccactattgtcctatgaccctgccaaatccccctctctgagaaacacccaagaatgatcaataaatactaaaaaaaaaaaaaaaaaaaaaaaaagaaatggtaacaatggacacctttaccttgtttccaatcttagtgggaaagtattcagtttttcaccattatgaatgatgttatctataggttctttgtagatggccctcatcaatttgaggaagttcccttctattcctagtttgctgactatatttatcatggcccgaaggtgaactttttcaaatgccttttctgtatctattgggacaaccatatggtttgttttttaatacacttatgtggtgaattgcatttattgatttttgaatgttacagtatacttacattcctggtataaattctactttttcatgatgtattatcttttaaaaatatgattaaaatatgattgaatgtagcttactaataaaaataaataaataaataaataaataaataaaaaacatgtaaaaagaaataggaaggtatggagaaaaatgagtgtttaactgtgtaagagaatgtggtgcccactgattctggattgttccaacttctcttgtaaatgtttgagatggacatgctaattacccttaact

SEQ ID NO: 475 - DNA, 8000 bp, Homo sapiens
  Locus number 87 genomic DNA region, treacle protein, Treacher Collins syndrome protein
gccgtgccctgcatgggaatccaaggtgactaaagcatgctgcttccccaagaggcactcgcagttcagtggtctgggagcatctggcttctaccactaacaaaggcattttctcttactggtagagaaatgctctgaggctaattttttttttaatgcactgttttgtttgttgctgtcttaatagttgccatgttatattttatcagtttaatgttctaattttgtgcttgggccctgaggcaattcagtgaagggtatgatttggaaaatgagggaaataaagaaattgtccacagaagagacagcctcccaggagccgaggacaaagcataagtgccgacaatgaattttattaggagcaaaacaaaaacaacctgttgccagacagaaggtattagacaatcctggtgtggttttgttttcgttctttaatttaattccagttctgcatttcttccagggtcagccaaggatgcacaatccagttccttccccactgccttccaaagccttccacattcctgcctccaggcctaaactcagtgagcaccttgcctgccctgccctcccttcttcttcaggagaggtctgtaaccattcctgcacttgccaatacttattaagtgcctgctgtatgcaggcactgtgcaaaatgttggaaataatgcaaccaacaaggcaaaggtaagtctgccttcagggagtttacattctactaaggcatgcattctcaaatggggccttgatgccctcgaggaaatgaaaactggttcctggaggtgttggtggaaaaaaatcttagatcttacaatggtttgtatgctcatcatgtacattcatcacccatccagccacccaagcagaaacctgggtgtcaccaccagttccagctcccagccctctctgatctcaggggtccctcataaggcctggcccgtgaaggattccactctctccctgcaaacatccatctgccttgcttccctcgctacccagtgtagatcccaggacccagaattttagcatctctttgccaatactttagactcctgtgcccttttttccccacccatctggcaaagccctaggcctggataaatcccactatgtacatacatctccccagcctgcagctgggtaggtgagccctgatggaggaattcactcagcaggacaggacgagacacacatacactaaggaccaccaacctcaactggggagccaaggctgtcaggcaattggggattttgtgggcaagttgcttctcaacactctgaatgatcattctttcaaactcctcaccacctcttcttcactctcagcagaagaccttgcctcccactttgcagaaaaaatagaagctcaaaatgaaatctcccttaacatcccactataaacctacatctacatctgcacccatcctctctttgttcctgcttttgggttctagagaactcatccctcctcctccccaagacgaacccccccaacccacatgcctgatcccagcccctcgcacatgcttgagagaactttactcgctgattatctcccctatttcttacactcttggttaacctctctctcctggatctgccattcacttttaaacaaatctcaggtttcttctaccttgaaacacacctcccctaacatacatattggccctagcactttatctttctcgtcctttttatacaaaaacttctcgaaagacccactgcctccctcatccctcctgcactcatcagaccactgccatctgaccccctccatcatgccacacataaatagccctccctaagtccccaacaatctccacgcctgtccataaaccaaagcccagggctgcaccctcctcctatctgacctctcagagcattccctccatcaagtcttcccagctttctaaaatgtctcccttggcctccttccataagcccactctcctgggctttctccaagctgtccagccactcctgatcagcctttgcaggcagatccttttgtacacagccctaatctgtagatgtacctcaaaacttcatcctgggccatctctcttctctctccacattcttctccctgggtaagcttctcctcatccacagccgcaattatcatctgtctatcgacaacttctcatcttcatctctagcccagacctccacgccacgtccaaacccaggtttccaagaaccttctcaacatctgcatgtggtgactgtaaggcatttcaagctcaagatgtctaacatagaatatatactttcacctctctgtccacatcctcctctcctcaatcaaaccacccccctgtctcagtcctcttctagttttttctatctcagtgaaaaatactgcctacttgtttgcacagaaacctcaaggtccattctgacattgccttttccttcccctcccattccaacacacctctgtgaaaactttagttcctgattaactctgggaaccttccactctcttcaactccactgccaccagcaccctccccgctgcccccgccacctaccacccgccccccccccccacatacactgtcttctccctggatgcctgcctgcactcctaaccctgacttgtcttcccacatctactcatacccaccagacacactccactctccactgggcaggcacacaggtcacagtaaaattcagatttcatcctgtacctcttgggcttacaccgtcagtggcttccaatggctcttaggatggaggaaaaaaaaccctgatgtggccaatccttcacatggagtctgccctctgcccaccttctacactccccagtccccctgctctccctccggactatgctacaaaggcctttttgtgtctattctctcagctgtaccttctgccctaggccctttgcacaggttcttccctctgctcaggtttcttctctctgactctcccttacacacagttctggtttcctcataaccattaatttctcagggaatccttccctaactcccaagaaaaaaatagatccctccttcctgttatatgctttcacaataatagcacacacgcacacagagagcgctattgttcagagctcctctaagcatttctgctgagaattcatttactccttatgacaacccagtgaggtagaaattataattatctccattgtacagataaagaaactgagtcacagtgacttgcccaaagtcacctagttaatgaggcaaagccagaatttgaacccaggcagtgtgactccagtgcagcttttaaacactatattattacataagaaaacactatccttttccttcctgcacttacccgctgtttgtaacactgtattgtatgactattagtttagtatgtgtctcctccgttagactgtaagctctattggagtagagacaattccatcactagactgtaagctctataggagtagagactattccatccccaatggtaggtactcaataaatatttgctcaagaaaatgggaaatgttgaatgtgtacagacacataacattttccattcaagttcaagacaaagataaccacatacctggacctcctagggttagggactcctgcgcccgtaagaaacatgctgccctcagattctcaatgggtcggtgaagttaagaacagctcactctaacattctccagcctacctcaccttttccctgccatccttccctcaacaactacaacagcctcacatttagtattaatggtatgtgctttggttttagcaatcttttaaaaacacaaaacagggtcaacctcctcggaaaagccagtcagagactatctaatgccctcagagcaaagtccaaactctgttgggggtgggggagttgtaggccttgtctacttcttcatcctcatgtgccctcatttgttccctcttccccacctcaccccaccccacctggacagcccagcagcgcagactaggggttctgggtttagggttcccaggcaatagcagggtgttttctcatgcctagactcatgcagtgccctctgccagtcctctcctttgcacccagcaatttcgggtgtctttatgcctcagcttagatatctctctggggttcggtgctcctccttggggcgcccataggctgcatctgtccctgacaaggcacacaagatattgaactatagttgcttggttacggacagtcgtctctgtgagctttgagggcaactgccatgtattatgcatcttttgaatccccctagcctagccgggtgctagcccaagttaggtgcttattacagatttgttcagttagcgaatgaatcaatgaataaactggcaattcgtgtctggttcatgggcaccaaaaaccgtgcgaaatggataaatgagcaggtaatggcagtacaaagttcggatctagagaaagatccagattagggagttcagagatgagtaaaacgcagacccagccatcagagaattaacaaggaagataaatctcttcaagaagccagccggaaggattaaaagagagtcgtccaagtcccggccggccccgggggcgggtccctgtctagccccgcatgctccgcgccaatgggcggtattgttgatcacgagtctccgcccccttcgccttgaggggcggggccggccactcccggagaggggactacgtttcccggcgcgccgcgcggccggagcgaaagaggagccggaagtgtggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccaggtaagcgttcgtgggccgtgtgcgagggccgcgtgcaagatgtggagatcagcggcccgcggcccgcgccccgtccccaggcgacccggcaggcgcccggagccgggtcccgcagtgctcgacggcgcggccaggggtaccggaggagccgcaatctctgccttcccactgcgacttcagttcccctgggcctcactttcctcatccgggcagtgggttgggccagaaagtgtgctcgcaggggccgaactttgtaattcccgcttcccttacctccacgcccttcctggtagcgggtattttaagtttcctaagtctcccgccacgtggctaggctctgcgcggccccccctggggcaaggaggttgctgcgagtctcgggggtggattgcgaccagcccctcgggggagcgcctggaaaagggaccctacagcctcttagttgagctggaactcaggcctttagcgattgtctgtactgagacggtcagctttggtactcgaactcgtggtacagtcatttcttacttgattaattcaactgttaatccggtactcagggtgcttcctggtgttcgaatggtgagcaccatctctcagccctcctggagcttacactctagtaaggtagacaaatcaaagaatcacaaaagtgactatatgcttagcaccgcaataagtgttaagaatgagagggatgggccgggcacggtagctcacgcctgtaatcccagcacttagggaggccgagactagcggatcacctgaggtcagaagttcgagaccagcctggccaacatggtgaaacaccgtttctactaaaaatacaaaaattagctgggcatgttggcgcacgcctgtaatcctggctactcatgtggctgaggcacaagaattgcttgaacccgggaggcagaggttgcaatgagtcaagatcgtgccactgcactccagcctgggcgataaagcgagactctgcctcaaaaaaaaaagagagatggatggcagattgccctggtcaggaatagctgaggtgtaaatgccttgtggtgggagggaacttgtgtacacactggcctggagaaagtccactctcttgagcccaggaatttgaggatacagtatgagccatgatcatgccactgcactccagcctgggcaacagagcaagacactgtctcaaaaaaaaattttttttaagtccatagcaggccaggtacggtagctcacgcctgtaatcccagcactttgggaggccgaggcaggcggatcacttgaggccaggagttcaaaaccagcctgaccgacatggtgaaaccctgtctctactaaaaatgcaaaaattagccatgcatggtggcatgcacctgtagtcccagttactcgggaggctgagtcaggagaatcacttgaacccaggaggcagaggttgcactgagctgagactgagccactgcactccatcctgggtgacaaggcgagactccatctcaaaaaaaaaaaaaacgtccatagtggctgaagtgtgaagtacaagggccagatgcccctggggagatggaggcaggggctggctggagtggtctggtgggcagtttgatcttccttggaagagcagtggtaaaccaatggagagttttgaactggtgagacagtatcctaagtagtcagatccctttgccctgtggtgtaggctctgctcctaatgcttgctctcagaacctcctggagggactaaagggtgatgggccctaagacgttatgtatgcttttcccagtttctctgaacctcacttgctcttcctaccgcagctatggtacttcacagataaggggagcaagagatagtacccatcttcattggagcaaaatatcctgccgtcatggagcacacattctagtaggagcagacaggtgacaaatagaaaaagtttaataagttaatgatatagtatatccaatgatagttggtgcttgctataaaaggcaggcaagggggataagggatgtcagacttcgattataagtagggtagtcaaggaagtctcattgagaaggtgtcatttgggcagagacctgaaggaaatgagggagtgagctgtgtagttaacaggggagagaacattccagacaagaagaatagcaaggccgcgttagaggcagggtggcctgacacatttgaggacagcaaggaggacactttgcctgaggtggagcagagggaaactgactcttgaaatcttagtgttaccggctcactgctgggcactgacagatggtcttgttcaaaccagatagcagcctgcaaggtaggtatcgctgttgtccccatgttaagaagaaatctgaagttcgaagacgtgacgagattagttcagtccacccgtgccccacattgcttagcctcattagagtacttgatatcctggcttattgacatttacagagacattgggccctctggcctctgctccaaaggcctggattccacctggttccctctgcttccaccaagggactggtaccatttgggcccagtcttctcccagcagactagtagactgtggtcatgccacctggatgcctcaggtgtctgggctgtgattcgtgctttgggaagattggctggccacgtctttgaaagcttttttaaaggtcaaaggtggggaaaaccctgtctcatggcctctaggcatggatagtgccagagaggctgggagctggatgaatgctagcttggaacattccacctctggcctttcaaaggggttgtctaaaaaggttttagttgggattggttgttcttcttgtctctggaaggtttgggacagaactggcagggccaagcagacatacttcccagagcaaaaagaccctctttttttttttttttttttttaaagaaagggtcttgctctgttgcccaggctggagtgcggtggcacaagcatggctcactgcagcctcgatatcctgggctcaagtgatcctcccacctcagcctcctgagtagccgggaccaccagtgcatgccaccattctcagctaatttttaaatttttttatagagacagtctcact

SEQ ID NO: 476 - DNA, 8000 bp, Homo sapiens
  Locus number 88 genomic DNA region, Feature name ha1p_62183
ttctgggggcccctgatggagaagtggagggatggaggggtataattatgtcaaccctccctcctctcctgaggtccaggaaaccccaaaacaaacaaacaaacactccgatccctgcctggggctcatgcttgggtggtgcccagctcagagtcttggttactgaatccctgaccgagccacagtggccaggcagggggccaaacatgcagccctcagagctccacccgttttccccgttaggcgggaatgaacttggaccggccaaaggaagtaacaacgtcagcccagccaggagaggctgtgcaaagagtcctgggccctagtccttcctcgtcgagcccagcccctgctgggggtgggatggtcaccaggcagacagttgtgtcctgcccacacccccgctgccggacccttgctgggaaagggacagggcctcaaggtcacatctggcttctcctgccatgcagaacaaaagcctccaatggacattattggcttaagttttattaaacaaatacacgtacagtcctcactacagtccagccactgttgtaagcactgctactaatgagaaaacaggcacagagaaggtaactaacgtgcccaaggtcacacagagagctcaggtaagtaaggtaggtccaattagccattctgaaggaatgctcagagacaggcttcaagcccaaaccctgctgaattgacaagctcactctctgtccactgcttcgcctccttggaacattccacaaaactctggcttttgccccagtggaacctcccaagggcccccagaaaatcaatctggcaagattcagggtgtgcattttacagacggagcaaggcagggctccgggtcccctgcaattttctcccccaggtccctctgcctctggttaatagcctgaatgtgaaatgcctccaatctcggttacaggagaagcctttggaggcggggatcattcatttattcatccatcctccaaggacatgtggagccttctgcgccccagagctggtgtggctgctgggatgcagcacaccgtgggtgagagcacaccttttctctctgcagcctccccctaaccctgcaaggtcactggtatcagtcccactttaccaacggggatgtctgaagctgaggcaggggagcaagtagcttgcctcacacctgcctggttggttgatcgatgacagtgttaagcagggattgcagggctggaggacagcaaggttgggtgtttaccctccagctccttccctgtagggtctccatgggtcgacttggccacagctatactctccaggcaccaagaaccactgctccctcttgcccctcagcctagagacagtgagttctccttgccattaccaggactgggattcaaaacccaagttcatatggatccagggcctcacctcctctggctgttcccctgccggtgtgtgtcctatgggctcagtgtacagcagggccggggaccatctgggcagcagatatttaccttctgcttccttgattaaacccctttgcccaatgggttctttacatcgcaaagcactggctccttttctgccctggtctctctgtcctttgtctctttccctgcttccacctctgtcctgttcttactctcctctgtctcatatctgacttgttctttctgcctctctctctcccccagtctctgtgtttgcctctctttgttcctggccctctccgtctcttccatctctctgcagtctccctgtcttctcagtctccacctcctcctctctcttcccatgttttctccacctcctgcacaccggtcacgggtcagccctccccctctgacaggctcggctgcccctcacctgcaacattcctcacctgtgcgcctagccagcccaagcttccagcagccactctgtcaatctgctgtctctttcatcgcaggctaccactaacctcttcctgaaagcaggccacaggccaaatgcaggggctttatcagggcctgtgggcgtaagagcccatcagggaaactggaaacattcctcgctctgcaaatgaccatgtttggcctggctcctgtccccatcttctccccacatgacccaccctgacagtccagccagatggctcagacacctctcctccaattctgtcagcctccaaaaggagctgggaggcccctcggaggaccatctcttgtagcaggggaaactaaggcccagagagtgcatgaccctctctaaatcatagaaaagagggacttggtctctcttgtttatggtgtatccccagagcctagaactgtgcctgggacttccataacttctgcctcagtgtgatccacatagaccgttccatagatttgcaaatagggactcagagaggtgaagtgactagtccagattcacacagcctttaagcatcagctcgggatttgaaccaaggactttttgaccccaaagcacaagatcacagcctcaaccagcagctgaaatgtaatgaggcgggccagtcaccactcttgccctcaaaaatgtctctcctgagcagcataccagcctccccctggcctggacgactgtaggtgctgatgtctttgcctgctgccttctgggccagtccattcaccagatctcctaccctccagggcagagagaaggggcctctcatctcccaaggatggctccagagacacctccagatccctgtatccccaggctctgacagactcgggaacctggaaaccacacagtgtctgcagatgttccagccacaggcctggctgccagccccaggacagaattagctccgtgtcaggagagaatttcctccctggtcccacgcccacatgtgggagctcgcactgagtcactgcagcagagcagagcggcacgggctgcctaacagactgtcccattttctttcgggtttggaaggggccacgacggagcttaggactccataagaatgggcaaaaacaaggagcttatgcccctgaacccagacagcccacctgcttagaggccaggaaaagcagctgatgagctcaccgactcagggagacccccccacccaaaatattcacgccactgcctggcatcctcccattagaacactactccttgagccttaaaagcgtttccttcctctccggggatctctgtctccagatccctgtctgttctgtgccctacaggctgacctgcttgaaaatctcaataggctgtttgccctctgacctctggtttgatccacaactgcaggcgtggagcgtgcggttgggtacaaaccctccagctccctccttgtcagaggtgtgcgggttggccacagccacactccttgggtgccttaactacttcctgctctagcccctcagtctaggaacagtgagttctcgccttcactggacccggagcgtggtagggatcccttgtactgtctacccttttgtcagtcctcccctgactaagttctcgttaatcacctcatttgagtgggttgtccatctcctgccaacactctgactcagaaaccagactctccacactttcccctccctccctacccacacatctatcaacaagttcttcccattttgtcctcccaacaactcacagctgtgagcatcacctctgcttacctatgtggctaccaggggctcctaactggttagaaacctatctacctagtacacagaccattttattcctagtagacaaatcttttcaagaagcaaaccacatcatgtcactccttgctgaaaacctcttagcacctccttgttcttagaatcaagaccaatgccttactatggcctgagcaatctagaccctgcctacctgaggactgagctgaggctcgagcccagacccagacggaaccaagttccatgagaacacgcccttgcaaactcagcctcattactttattggacacctagctgcccttgtaaccatctccccagcagccattcctagtcacagaaggtccccagcaagagcatttgatggacatctgtccttccaggccaggaagcccctgtagcccccaataatgggtcccgtacacaagccctaagtatcttcccagccatccagcttgtgcctctccccataaacaccgccccagcccctggagctggcctgtaaacaaattttctcccctgcgcatatcccactggactgggaggtccagcaccatatttagttaatcccctgacgtcagccttgggtccactcttgcaaataatccccaagctatgaacacattgtagccaaagggtggctggtgctggggatgcttacagcttgctcaggatgtggtcaagaaggcagctggggtgagtgacttctgcccatgctgggagccagcctgtggcacgcacttggtgtgctgttctgggtgtgggcttggaatctcgactctgggaggcagcggaggccccacatgcctccagaagcgccccctgagaagtcactcttctcttacaaccaggtcagcacagctcaccctctgcccttgcttctcttctctggcaccctgagatacctgaaaagtggcaactcaagaaacttacccagccacagggtcccaatctgccagcgggtggggagaagggcaaggaggtggagaacccagactcatccgctctggagcccttgtgtttgagtcccatgcctcgctccttcctttctgttgctctggtgagctggataaggaagccatggcttctgccattcccagcttcagctcagcctcccacctccccagcatccctacatcctctgcaagaggctctgcaaagcgtgtttcactttattcaagtccctcagctgaaaccaagctattgtctggcctcagtcgggacagggcattaacacctaacaaggaggtggtcctggctgggtgacctggatctgctctccacacctccaagtctctttttccacttctggggcatgtggaccacccaacataccatgatggtgaaggagaataacctctgtggcacacctagaaaaacagccagcccttcatcaggtcacaaacaatgccagttgcccattattctcatttcacagatgagaaaactgagattcagattcagtgaagtgaccgagtgagcacgtgggtagaatcaggagctccaggctgggcttccagcttctcctcccttggttttccatggaatcctgtcacatatcatctggaagtaggtttcacttctagctctagcacttcctggctgtgtgacctcatagaggttacttacctctctgagcctcaggagcctcatctgtagcatctgtctcaaggagttgtgaggattcaatgaaacaaggctggtgaggtgcttgtcaccaccacagccactgcattaatagggaaaggggatttctttcacagggtgaaactgaaatgtgtttctactgctccctcagtgaagtccactgttttagggtcccaggagaatttctcaggacacaagccccttcccagctctctcttctgctcatcccctgagcacatctggtccagggtagccccgcccggacctctcgctggccgctcaacagcctgttccctgcaggccacctccttctggagacttcctgccctcgccttgactgttcccctccagggctcccatcactgtaggaagtgtgctcagcatgggtccagggagctgggaatgaggtttggcacctcttcttgggagaggtcagaaaatagaggttctattagagggtgaggacgggcaaggcaggggcccctccagacaggctgactcaaatccctcaggaggctgagaagcttccgacaagacaatcttgatattgggctcagctctgaaggccaaagattcttccttccagtcctctaatcctcctgtttcccttcctccatccttccaagaaatagtcattaaatacctattatgagccaggcctggatctgagtactggggttgcagcagggaacaaaccagacacatccctgcccttggagtcgaggggtagtcgggggtgacagatgctaaacagtcaagtaaacaaatacataataaggaagacaaacacatctggagccagactgcctcggtttgaatcccagctctgctgtgtgaccatgggcaagtcatcacacttctctgtgcctcagttccctcatctggaaaataggagtgatcattgctcctccctcacagagttgttgcaaggattgaatgttggtaatgggtttatgttggtaatgttttagaagcatgcctggttcatcggaagctctatgtaaatgctgaaaaaatacaatgaatataatagcaggcagtgatttgtgctgtgaataaaatacaaagagggtcatcttctcagagaagcttcttggaacgctctccctaacatagaattcccctcccccagcatttatgccctgttccacctttgaatggagacctgaatacacagagagggagacatgggctggtgctgtggaagagcatggtaggcagtgggaacagcagatgcaaaggcaggaggatcgcttgagcccagcagcttagggctgcagtgagctatgattgcaccactacactccaacctgggtgacagggtgagacctccatctccaaaaaaaaaaaaagccagtagtgggcaacgtctaagggtcacactccttgccaaatgctgtgggagtaagatggcccagtcactaccttcatgcagagaaagtggttgcaggaacagatcgtggcacagtcagtattctgagatgtcacctaaattccaggcttccagcaaactggccatgctgggcttgcattacagaacaggggttatccacagtccccacccctccctattgttccctggggtaataagccagttgcaatttgccattgagtttgtccagggtctctgctgtggcagaaataagtgcaatccagtgagagaaagaggaaccaagtcattctcattttcagctttcataggagagcacgtatgtctttgtggacatgaaaaatgttcataaatgggtcatttgggtctcctgcctggccctgttggtcactgagtgtgtggccctggctctgcacaaagtaaagagaaagggctggggaaatcaggggatgcttcctggaggaggtggcatttgagctgagccttggagggtatgaagcctttgccaggtggagcagccgagggaaatgacatacctgcagaggaacagaggcttgaaaaagtgtggttaggggctgtgtgtgtgtgtgtgtgtgtgtgtgtgtgtgtgttaggggaggggagaaggcaggagatgtggctaaggaaagaagagggtttcagattgtgagatccctgcaagccatcaactttatcctatgggcaatagggagccatggatggttttaagcagagggtatcatccttctaaaaagattccagcttctaacctgggtggctgatgtgggcactgcgttggaagaggaaaggctggaggcaggagaatagcaagaggcctggtgaactgaggatccttctgccagttccaggcctacccagaaagtgcagtttttggaggctccaggcatcaggatgtcccatcagagagccaggaagccaagcaatctctttatttttcttaaggatttttcctcagcccacagggactggtttgcttccagagccatttccatggcaaccaccaatgctccaagaaaggtcttgagtgagcggaggagtgaggaccagagatactcagatgggtcttcacgggaaaagccaggtcacagagaagggcccatactgtccagtcctgggggctgggagccatcttcccccggagtccatgatgccacagataagctatggttgccatggtaacaccgagtcccccatccccgggcctcatggacccagggcctttcagcaaggcgggtaggcagagacaggagggaggcagtgctgaggggcagccagaacctgcagctcaccaggga

SEQ ID NO: 477 - DNA, 8000 bp, Homo sapiens
  Locus number 89 genomic DNA region, Feature name ha1p_69418, Ensembl gene ID ENSG00000180667
attactccaattgctttaaaacttcaaaaatcaaagtaaaagattgcagataagcaaagtgctaatttgcagaaatgtgaaattatttaaaataactttagtggagggataaggctagcacaaaagcaaacactctttaggtgtgcaaaaaatcttacaaaaaccaacccaaagcagagcattattacttgaaaaaaattttttggaggaagtgctcttaacaaaaagctgagaaaattaaattccccccgataaactttacgcaaatgaagaaaaaactgaggactcgaatttcaaggaatttcaattaaaaaagtaccctgcttaactttaaaatgttatccaatgtgacaaagaccaatacatgaattgcattaaaacacgaggccaacggtcttttaaagcttcaggaagctgctcaggcacctattccctcatacattctacgttttatatgctagagatcttaaacagggcacaatcagttcctgttttgtgataacattctcaaggatgagactcatccctgtaaaaattgcttgtgatgtacttatcagtggttaagcacacatttataatgtctaccaaattgcaatataaaatcagtttggacaattctgagtatcttcatttgatgaatcaattcataatttagaaacttaactcattcagagtttttaaaaagactcagttactggagacactgtggtaaatgtccagtggactcacaggaggccttccacattacccaaaatgtgatgctttcttctacaagttaaagctgctgggtgctagtttataatactcaatctcaatcgtatgcccagtggactcacaggaggccttccacattacccaaaatgtgatgctttcttctacaagttaaagctgctgggtgctagtttataatactcaatctcaaccttcaggtcagtgtcagtaggtggcaaggatcacctattctgtcactccagcagaaagaggcatgtatgtacagtttaccactgtagacacacatctgtaaacttgcacactaattttaatcttaacaaggaatttcagtgtcttagtggttttaagttaaaaggatggttcaagcattgtatcctttgttctttagggttaccatagcttattggaaaacccagagccttctggatgtgtgaggtagtaggcttcaaccctcattcatgcataggtcacacttctccaaagttggtatggcctgtctccttggcatgttcccttgcttctgcttgtccagttaatcctttctgacataccatgcatctcagggtgaagcggttgacatcagtaaactgtctccttcttctagcttcatctgctaattccagtgcttgtacaagaacaatatcatcattagaggagaaaatggtcagaggaggtgtatctggatcagggaagttacgctgaagtggatcatagtggatgccatcataaataagcagaacccttttggtatatcctgcatcttccccaaaacgatcaattcttactgtctgtgtatccactacacatatttcacattggtaaaacttggacaaaatcgatatctctattgctcctccccaagtgtcatcccttttgatccagtcacagtactcttgatttgtttttcccagtattgcctcactatagaagtctggatcgcttgctacaatttgtgctatgaggcgtctcatctcaggggcacaagctggattcaagactcctccttcgacgacatagtacacactagtaaagaggcaagagttgtctgctgggaccacggttctggtaagcacaggcaaagtttccctgacgtaactagaagcaccacgtttagtaaatgcaggtgaacttctgggcctggtttggtcttcttcaatgatcagcatgtcacctgttaaaaataaaacaaatcccgatctgcaaagaaattacagaagaaaccgagtgttctctagccaagtctgtaaattacaaactgaaggagttaaagcataaactggggttactaaggagaatacagttttgcaagtaagttaccagtaagaatctttgttcactgaattttcataaagatgaaaaaagaacaaaaaacacttgaggttgcatcccaatttagtgaaggggtctggagtaaacaacttcaagcttacctaaaaagatacatttcaaaaacaaaatttcctttccttatacagtattttacagaaggtgctcactacagagtaggccgctagggggttctccttctccggaaacttatctactctagagtgtttacaacatccttgatacagcaactgaaagcttttaattataaacactgatgttcaagttttgatatggcacagaaataactgctgctggttagaaattgaaagagctttcagtgggtgttttaaaagctaactcgaaaatgagtatgcctgtcaaacgaagtatctacgaaggggactgcaaaaatgaatcaagaaaaaaaaaatcctgcacccttgagatctcatcggtgatatagggaaaaagagacataaggacagagaaaataggccctactttatatttttgtggacgccgagggaaaacaaaatgggatagtttcaaagccgaccagaaagcggaatggggaagggggtcttcaaggctttgggttccctttcaaccctgtgtcaagacaaggagttgctagacacttgccctggcccccgtcagcattctctgttctttgatctatcctcgcccctggcctcaaagcccccccgccgactcacagccaccttgccttgactggtgttttgttctctctcacgcccctctccatcctcccgggactttccctggccccagccctgattccttaccagattggatgggcaagtcttccagaatggtatccccattgctgagatccaggcactcgggagggtatccgacgaggattcgctgaccgccgggggcgatcccggtgatggcggcaatttggccctggagttcccgcacccgggtccggctggacagcccctgcaaaacatgggtgccgtccttggccttgcagcggagccgccacatcgtgtcggtccggctgcccacaggccaggcacccgcggggccagctttggtcccggcagcctgttgggagacgccgccggggaaaccaggcgccgggtggactccaaaatggcgacctttagcggggccaaacatcgcgagaagttgcgggtggttgcagttatcgcgacgcttcggtgcggcttctgccttagtaccttagcaagcgcgaactcttttaaagtgacaactgatttttcccccaccctcagaacgaagatgtaaacctccgtattcctaaaggacaacgggtcttgctacctatagagcgagtgaggtgccctccgcgtgggtagcatatatgctcaagaaaagagggcgggggaaggagttcctgaatgaaggtctggagattggaatgtgaccttgcacttagtgaggtcggaaattattaaattggggcttccacactacacccagactacaccaggagaaacagaatcatagttcacaacgcaaacgaatgccaggaatggtcagtgagtcaaaggaccagtcaaaaacaatcacacttgtgactagactcgtggctgcattaaacattgactcattggggttccaggggccaaaagactggcctttctgcctccctgggactgtgcttgaaaacgtctatttgccacttcagaaagcacagtatgaggtcagcatctgggcccagggcagctgcctcattcaggtggtggcagtgtaaggaggagtcgtgtaacgcgtgtcatcagattccagttcagttcctgggcatacaaatatgaagacttcattcctgccttcattgtaacaagtattcattgcagttgggagacagggtggggtgtgagacacacagccactgaatttcaaagcaacgtgataatgctagattatctgtaccttttcaaacgtgtatgcctagaacccaggactgtgcctcgcaaataaaaagtgttcaacaaatactggctgaatgaataaagacagagttgtatagacatagagagggcaactagagcactctgggagttgtaaaaagccttaaagaggagataactgtttgaacttttggaagaattagtttaattcccaggcgaaggaggaataaagacatccctgaatttatatctctcttttccaagaaatccatactcattgttctttatccagccgggattcagacagcaagtcccacttgccaagagtgggtttatcaagcatcaaacgggcccgctggggcaactatgaaaagtgtagttcacttggtgcaaactcacctccactgtaaaagactttgcttctgaataaattatatgtaatgtttccatcttttcacatctttcatgactcaatttttttttgctggtgcaattttcctccttggttcttcaagacgactgcaacggatgatacagcctgggttagggggtaggtaggagggaaggtaggagtggttagaagtccaccggggtggccgggcgcagtggctcacacctgtaatcccagcactttgggaggccgaggcgggtgaatcacccgaggtcagaagttcgagaccagcctcatcaatatggagaaaccccgtctctactaaaaatacaaaattagctgggcgtggtggtccatgcctttaattctagatactgggaggcaggagaatcgcttgaacacgggaggcaaaagttgcggtgccaaggtcgtgccattgcactccagcctgggcaacaagagcaaaactccatctcaaaaaacaaaaaccaaaccaaaccaaaacaaaaaaaactccaatggggtgtatgggtgggtccagggaagcttctggttcaacgatgagagtggttgattttcttaggtcacagcgtctgacctgtggagccgggtatgtatacaccctaaggcataattagctcaagtgttgtggtagtttattctagcaaaaacatctttaaagcttacgttcccatttatggatctaatgaggttctgctgggattcaggaatgagagcgttaatctttgcagcattttctcgtcacccggcacacccgctctcaagacgcctaccgaatagtctactctcgcgagagtcagaaaaaagtcaagctttttattaacaccgcccccagccctattagttaccaagcaacagtgccaccaggctcctcggcgctgggaaactcaggagcttgtgatctctctggttccgacttccagccgccttcccgagccagttaggcgattgcgaccctgccccgccccctgggtcctgcaggcgcccgattggtggatgattctctccaggtgaggacctacgcgcgagggggcggggccagacgggctcacatgatttgccggcgactgtagcgccggtcccggccacaagctgtcggctcggttcggtcgcgttacagggcaggcgccggggccaaggcagggagggatcttaggagagatcgtagggtgagccacagctgcgcagccccgggtagggtctagcggggcgggatgtgggggctgcgtgcccccggatgaagtgcggggagaggtgctggtccccaggcatggcaggcagcgcggacgttctgggaccgggagccacagtctgtgtttgggttggaggatttgtgtggtcagtaaaggaatcgtgtaaggctcttgaaggcgcaggatcttccgtcctcaccagccccctgttgtctgaattgggggcatgagctcaggactttcccactccagtttgaatcagggcttacccctcttcctgaggtgaccttggggaagtcatttaccacctcagcgctccggcgttctttagactgagtcccgggggtaactagggagagggtgcggagcagggcttgagaatgcactagaggagaaatgacgacgtgctagggctgtcttggggtccagttactgtttttccttcagggaatatgttcgagattttcccacgtccctcacttttttcttttctttctttctttttcatttttcattttttttttttttttttttgacagagtctcgctctgtcgctaggctggagtgcagtggcgggatcttggctcactgcaacctccgcctcccgggttcaagcgattctcctgcctcagcctcccgagtagctgggactacaggcgcgcaccaccaggcccggctaatttttgtatttttagtagagacgaggtttcaccatgttggccaggatggtctctatctcttgacctcttgatccgcccgcctcagcctccccaagtgttggaattccaggagtgagccaccgtgcccggcctcactgtttgcaaaactgagtcctaccgttagattggagttaatttcctggtaatgtacttcgtctatacataacccaccccaccccaactgctgccactactctgcccagattcttaaaactagaatctgaggtcatgaaaccttgagcaggacacttaattcgatgaatctcaaattttcaatctgtaaaatgagaagaaataatggtggcaaaatctgcctaattacaagattattgttaggactgaagaagataacgtctgtaaatgtagactcgtaagtcagaagataaatgtaaggttctagtgcaactctttttataggtgaggaaacagagggctagagaagtagctgctaactgggagaaacaggactgaacctgcctcttggcccagggtgtttttacttataccacacggatccaatgcactgactttttttaagttatgtcttctttcttccccttcccttttttacattctacttctctgtttcagacatctgaagagctgccatgtctggggcatcttcctcagaacagaacaacaacagctatgaaaccaaaaccccaaatcttcgaatgtcagagaagaaatgttgtgagttctggcagagaggagggactgctctctctcagcattttatcttgggaatatagttataatcctggactctgctgcttggtgggagtgataaataattatttgacatggaaatttaatgcaaagtctccagggtagaatgtcctgtctaaaacaagtagacttagtgaaatgtctgttcttggggcttgactactggtgtagtccagcagtttcttactgctttcttaaactgaatctctgtctcctgggatgtttgcacactggcttgctgatggaagttagaactaacattattgtacacacaatgagtaaggcacagttgcaggtgcaggaattacttggagctggtaatgttaccagctttatctgttgggctaagttttgggagagtgctgctcattgtagaaattgcagatgggagccagtgctgcttggtttccttcctacaggcctgaggggaatgagccctgacacttggcttctcacagtgtcttgggcatcttactttctcacaggtttagcctttgtactttgtaaactattttccctataggttcatttttttgaggacagctttcacatgagcattttcatttctatgcctgtcttttagatagaaacagcaggagggtttgcgaggagatgaagcatcatttcctgtccccaagcatctgtatttctaagcatcataggctgcatagcttcccaaaagatctgggactctgttccccacatattttggggaacttcaaggaatgctaactcttgcctctgcttctggatggcaccattcctgcagaatcctgtcagtcagttcttctcacttcagtggttatatatatatatatatatatagccagttagtcaaggaatatatatatctcagcaggtggaaacagccgaccagcatgagaccaggaattatctcatgttcaaagcttttcccagagcctcgaccttgatgtcatgcccttgtcagtttcatgattgacaatgataatctctcttcacc

SEQ ID NO: 478 - DNA, 8000 bp, Homo sapiens
  Locus number 90 genomic DNA region, protocadherin beta 3 precursor (PCDH-beta3)
ggacggcgactcgggccagaacgcctggctgtcgtaccagctgctcaaggccacggagcccgggctgttcggcgtgtgggcgcacaatggcgaggtgcgcaccgccaggctgctgagggagcgcgacgctgccaagcagaggctggtggtgctggtcaaggacaatggcgagcctccgcgctcggccaccgccacgctgcacgtgctcctggtggacggcttctcccagccctacctgctgctcccggaggcggcaccggcccaggcccaggccgacttgctcaccgtctacctggtggtggcgttggcctcggtgtcttcgctcttcctcttctcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcacttaagtgttaataaggatctactgaggctagtctcgtttaatttgtggaaagtccttttttactgctttgcccattggaggtgtctccttttattagaaagtaaccatcttattccaattctatgcatgttactggtatttataaatgtatgagtttttttgcggtataataaatgtaaattttctttgtattctaattgttggttagtttcattgcaatttaattgcatttaaagtgtaaaagtaaattttgtattttcagaaatctttaagttagagcatcttttccagacctcacagtctatggtcctagataattttgaagtcctacatttgaaaatatttgttatcattacatgagttatattttccagcccagaatatttgtgttttttatatcctcttaggctagtgtaaattctatcctgtgaattcacattggctaaccctttaaataggtatatttatgaataatatagcaagcaccgtccttacgtttttcaatatatgtaatttttttttttttttgagatggagttttgcacttgttgctcaggctgtagtggagtgcaatggcgcaatctcggctcgccgcaacctctgcctcccgggttcaagcgattctcctgcctcagcctcccaagtagctgggattacaggcatgcatcattatgcccggctaattttgtatttttagtagagacagggtgtctccatgttggtcaggttggtcttgaactcctgaccttaggtgatctgcccacctcagcctcccaaagtgctgggattacaggcgtgagccaccgccccccagtccaatatgtatacttctttcaagtgttgacatatgaaaagtattagtctttagagattgtaagaattttaactgttggattctacaaggcactaacatcataagtgctctaataaatttttgtcaaaagtcaatcattaatattcaaaaatgtagataaataatacatgtctagcaattttcaaaggcatgctaattcatcatgctttctctttcaaatagtttttttaagagccctctgcttattccagtccccccctttaaaatcttttaaaattattaataacctattaactttgagcacttcattaaaatccaaaaaatttgagggagtacatgtctttgtcctttacctttagaaccctcaaacatagcttggtattgctgtttttaaaattttctggagcatttaggattcacttagaaacaagcctttagggagaaaaatttatctagcaccactcactctatttttttgcactgactacttctatttttccccctttcatttccctagacttttcaatgcttttttataaaggtgcttgagttctgtttctcaacagctccctcatttattgaatgattcacacagtcactggaatattataggctcttaataaaatttttgaatgattgaaagagagaaaagtattttacctgtgatatattgatatttaaataaactagaacacttaaaggaaaacattttgctggaatcaaatactctttggtgtacaatgaattataattttgttattaattgaattggttaccattgtttgaacatgcagttatcattctgttgtcgctttccttcaacatatttttactttttctcttaatgcttaaattgagcctcctttcctgtccactggcttaaggaatacagatggcttttaattttattacttaaatttccttccatagttccctaaatgactcacccaactgttttcatttcttgcagtttactttctgatccatacattaaaacaaatcttaattcttaatgttactcagtctatctttatatttttatatcatttttacatacatttgaatgagctatcctattaaaattttaatattaactttgaaggtcttgttttgagattagcaatggtgtagagcgctgtgttggtatcaaaagtctctgatcaaccaactcattacctgtaggattttggatgagtcacaaagtttcttttcttctacccaaatgatagcaggtatttgaatagcttgcagttatactcaatataaagacataaaagtgaaattgctgttatttttagtatcactagtattaagagcaaacattcttgataattgtgtagaagtacaaaagcggctacattgaacacatatttgcactgttttatttctgtaccaacaaccttgcaatggcttccttttgttcttagaataataaaatccaagcgcccattatttggccttggtttaccttttcagccttcctttccacttactcttgagacattaagttttgtattcactgtacttcattcattatctattaatagctatgctttgctctctcagggccttcacacattctacagtcttagcctggcacacttctcctatttcatgtttcagattaaatggtgcaccttgggggaaactttcttaatcactctccattaagttaggtccccgtattgcatactttcagtgcactcagtaccttttctatgtagcacttttcacactgtttaaacatctgtttaaagactgtacacccactagatggaaaattgttgtaagatatacagacattgtcttgttaccaccacttgcctaacttctacaaactcaacaattatctgtggaaataaactaatacagatgaaatgaataattgtaaatttgctctgaaataagaagagaaagcactttaagtgttccttgagcatgataatctggaagaaattaggtatttgtagtcctctggatccatctctgacatgatatattttcttttttaccaccttgcaggaggtgtcttttccttgtatttttctggtatatgcaattcgggctcatttcacaaagtttaggaaaaaaagaaaaacataaataggatagtgaagcatgctatcatctagagcaaaaatcttttgaagtttgtgtgtaattattacaaaaggggaggggtaaactagtatgtgtacacttccgttaaatcgtgtaaatgaggactctaccaggaagaatcgctgctcgtagataaaagtgcattttatttccctagattgcatttatttaattcatataacatgagaaactcctccagtagcgtcaactagggttgataagaataatcgataaagcaaaataaaaacaccttctccaagattttgtaactgcaagcgaacgcatggtggcgctgttgactaagaaggcgaattaaaccacaggcattgtgcatgctcggtgacgcacggatccagtgtggtaaaccagcggttgagagcccaggcagatttttgagccagcaagtctgagcctctggaaaggcttattcactaggccgtctacaaaggttgtggggcaaaagactgtttcccagctctgtctgaggttcagcttggcgacattccctggaagagcgtgacggaaagtgcaatggaggcgggaggagagcgatttcttagacaaaggcaagtcttgcttctctttgtttttctgggagggtctctggctgggtccgagtcaagacgctattctgtggctgaggaaaaagagaagggctttttaatagccaacctagcaaaggatctgggactaagggtagaggaactggccgcgaggggggcccaagttgtgtccaaagggaacaaacagcattttcagctcagtcatcagacaggtgatttgctcctgaatgagaaattggaccgggaggagctatgcggccccacagaaccatgcatactacattttcagatattactgcaaaaccctttgcaattcgttacaaacgagctccgtatcatagatgtaaatgaccattctccggtattctttgaaaatgaaatgcatctgaaaatcctagaaagcactctgccaggaacagtaattcctttgggaaatgctgaggacttggatgtgggaagaaacagcctccaaaactacactatcactccgaattcccacttccacgtactcactcgcagtcgtagggacggaaggaagtacccggaactagtactggataaagcgctcgatcgggaggagcagccggaactcagcttaacgctcaccgcgctggacggcggctctccccctcggtctgggacagcccagataaacatccaggtcttagatataaacgacaatgcaccagaatttgcacagccgctctatgaggttgcagttctagagaatacccccgttaactctgtcattgtcactgtctcggcttctgacttagatacaggaagttttgggacaatatcatatgcattttttcatgcttctgaagaaattcgcaaaacttttcagctaaatccaattactggtgatatgcaactggtcaaatatttgaattttgaagcgattaatagttatgaagtcgacatcgaggccaaggatggcggaggcctatccggaaagtctacagtcatagtccaggtggttgatgtcaacgacaacccaccggaactgaccttgtcttcagtaaacagccctattcctgagaactcgggagagactgtactggctgttttcagtgtttctgatctagactctggagacaacggaagagtgatgtgttccattgagaacaatctccccttcttcctgaaaccatctgtagagaatttttacaccctagtgtcagaaggcgcgctggacagagagaccagatccgagtacaacattaccatcactatcactgacctggggacacccaggctgaaaaccaagtacaacataaccgtgctggtctccgacgtcaatgacaacgcccccgccttcacccaaatctcctacaccctgttcgtccgcgagaacaacagccccgccctgcacatcggcagtgtcagcgccacagacagagactcaggcaccaacgcccaggtaacctactcgctgctgccgccccaggacccgcacctgcccctctcttccctggtctccatcaacgcggacaacggccacctgtttgccctcaggtcgctggactacgaggccctgcaggcgttcgagttccgcgtgggcgccacagaccgtggctccccggctttgagcagcgaggcgctggtgcgcgtgctggtgctggacgccaacgacaactcgcccttcgtgctgtacccgctgcagaacggctccgcgccctgcaccgagctggtgccccgggcggctgagccgggctacctggtgaccaaggtggtggcggtggacggcgactcgggccagaacgcctggctgtcgtaccagctgctcaaggccacggagcccgggctgttcggcgtgtgggcgcacaatggcgaagtgcgcaccgccaggctgctgagcgagcgcgacgcggccaagcacaggctggtggtgctggtcaaggacaatggcgagcctccgcgctcggccaccgccacgctgcatgtgctcctggtggacggcttctcccagccctacctgcctctcccggaggcggcaccggcccaggcccaggccgacttgctcaccgtctacctggtggtggcattggcctcggtgtcttcgctcttcctcttttcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcagttaagtgttaataaggatctactgagcctcgtcttagttaatctgtggaaagtccttttttactgctttgtccattggagaggtcttttttggtctggttcaaggcaagtagcaagaatagagcaaaatatcaaatccagggatggcttaggtttcattaacagtactggaaagtagttgtgtggctctgaatgttttgtatttcaatcgagaatccttagtcgatagaacattttgtttatatattgattctactttttctgtagttaatccttgcatattctcctttcatcctggcttgccaacgcagtcttaattccgccttttttttttctaatggggagcaaaaagaaattcactgtcttttaatagtgatttcaaatagcttattaaaataactccattcaaattttacattataaagcaatgtagagagagttccaaaccaccaattttataatttcccttgttgaatatattcatataatgtgttctataatatgcccaaagcagctttgtctatagttaacaaagttttaaggatagacaagaatgtgttttctttaataaatagtaatatatcatctttttagggatatagtactcaaatgaaagtaatttagttcattttctgtgttgacatttgcaattaatatttcaatattttatgtgcttatattggccaaaatatggacacaaatatagactaatatgggtaattaccctttggtttatctaaagtgtgttcatgatgactgaggaaaaaaattaaacctatgccatttaaaaaactgactgttcttttccatttgacacaaaaacgttgtttagtaagacatctggtggaacaactatttgtttcataaattctgagatgtaagtgttatgaatctgagagacaatttttaatttcaagaaaatacatgggtatatgatatctaaatgcttcaaggtaaaagtggtgtcctatccagtcctattttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacacccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccagtcctattttattattaatacctacttgccacttgtatgatgatataggagaaagatattttctttttttcctgtcttggttccctccttcagattttaacctgacatgatttaggattatatatggtctttctgggatagaaactgtccatccttatcagcatcctacctcctgcaatgtaattaaaagaagatgtacaagaatagaaagttctaaaaaggagagggcaatatcgttgtgaaactc

SEQ ID NO: 479 - DNA, 8000 bp, Homo sapiens
  Locus number 91 genomic DNA region, Feature name ha1p_74221, Ensembl gene ID ENSG00000125895
tcatcctccaagagcagcggtttccaaacttttgtatttttagcagcagaagccatcctccaaacaaaaccgtatgcaaaacctcagctacaaaacagatcagtgggctgcttgcccgtgtggggcatgggctgggccccgagctctccctccagcacccagtacttcttccacaaggccctatgtgagctcagtttaaaaccccagggccttggcaggggtcaggtgggcgggagcagggggtggaccttgtagcactggagctaaagcagccagataaggtgggctagttcttaagacctctggagggtgtggctagtctctgagacctggacaacttcattctccaccagggcctggcccccatccccattgagctgtctcatgcgcaggttaatggagccgtaggtcttcctggagcccttgccggggacgaaggtcctccggcggtacagctcgcccttgcacagggagaccatgagcagcaccgacaagagcatgccgcccaccgtgagcagcccgaggcctgcgatgatgcacctgtccaggtgggagcctaggcgggcgtagtacatctccagtcgttccatctcccgcgctgtcactgtgtccggattgactcgagcctcacgggggatggcgtatgctgtcaccaccagaagaatcccactcaccaggaaaacgagggcggaaacaaagccataatccaccgggcggctcacgggctccagggctggcccctcctctgaatgaagggacagatcatcccgctgggatcggggcagtgaggagacacccccagggggactgggtgagctgcccagtctcgtgttcccagggttctggaaatgggtctcatgctcctctgaggagaagcaggcattctccacaccctccctggttggggccactgggcccaggggagctgatctccttggggcttggggaccattgctcagtgtcttcagttccagaccagggggagatgccattgggaaggagggccccagctcatcccttggccccttggcagctggaagagaaaaaagaaagtcagttgaatgtagcaacctctccctgttgtggaggacatcataccagtccctaagcacatgaaggtgagtcaggcacaattcccacttgggggtgtctgccagacagaggggaagacagggaataagacgatgacagaacagtgtgatccaagcccagatcccactctaccaccgggtggggtatggctgtgggcaattcactaatcctgtctggcttcagtttccccacctataaaataatactactactaccctctagttcgcaaagctggagtaggattgagataacctatacgaagtactcagaacactaagtgctcaaagttagcgatgagttcctattatactggagggaatgtaggtagtgtgaatatcaggctcaaatcccagcttcaccacttgggcttgggcaagtgatgtgacctctccagattcggtcttcatcttatctataaaatggtaatgaataaaatgcctccctcataaggttgttgtgaggatttcataaaatagtgcatgcaagaccctggccagtgcaatccatggaccttgttgtatgagggaaggatgacggaggggtgggggagggggtagaaatgcagaagttgttgtgggaacaaagaggaagggaagtttctgggagttggtggcatttgagccagatctcagaagatgaattggatacttcccagcaatggaaggtgatgagggcattctggaaaggggaacagactgcctcagaggccagctggggccggctcacagaggactctgaaagccaggccaaggagcccgagagccatgcagagctgaggagctggagcaggaagtgcctcggcttcagaagaaaggaggactgatgagatgggagggggcaaagtggaggatgggggtccagcaaggaagccagcaggttggggatggcatggctaaaagggccaagaggaaggggcagactggagagccatgactaggtcaaagccaaatgcctttatgtaaacagaagtgtggggacctggactagaaccacaggaggggaaccgggagggagaggcgagaagagggacactctctgtgctgcaagaggagttaccccacccaagaacctgaacacaaacccacccagacacagacagcacatgtgcattcccgctgaaggatactgacttacagcccggggaccatatttggctgatagaagttttgctttgttttgttcctggcctgttcatttgtttttggtgaattagttgcaaatgtataaaaagcaaaagattttagattttacattttaaatgttggattcctggcttctcctgcaaaatgaaagaatctggccaccttaggcccccgttcccttgtaacactcgcctggagttggcaatcggggctcttaggcagatctagcctctccccgacaggtcccacctcagcccccttccctgcctggcatgtgtcattcctaatccacagcagaactgcatcattccttgtatacactgatggcctgagggcacatacactcagagccctaggcgcacaagccatgggctacagagaccaccaggtgcagagtggctcacatgctccggtgtgtctacgcacacatacatgcacacacacacgattctctgcattctcatgccggagtttattctccagtgcactgtggttcgttctctgtgtgtgtgtgtgtgtgtgtgtgtttgtgtgtgtgtgtgtgtgtaaatatgagcaaatgaagtgaggatgaatggaatgaatgaatgaatgaaactcaaagagcctcagtgcaggaagacatgtttttcaatctttctgaccttcttgtcaatatggactagcatcagacacctcctcttagcacatatagggcctttcatgtgagtacaaagctcttttccctttacagcccatttctatcactacgtctctctttccagagtctcaatttagtaaatgtttaccaagcacctactagctgttgagccatgtacccgacacttcatgcaggagtatctcatatcaccctcaccagccccacgatccggaattactgtctctatttcataaaacatggccaagatcccatggcatgtatgggagggtggaggacaggagttgaatgcagattccctaagaattattatcatgtacaaacctgcaaactcatacccctgtgctggtggcatcactccaccagccttccctggctctgcatccctcactcatagactcttcattttatccagctgtttatcagcaaccgtgagcaccttgagagcaggcataagtttgaattccatctgggtccccagcctgcgcccagactgcttttactttccagtgaatagacagaaaaaagagatgtgtttgttggttggctttttactcttagcaccaaaaacattttcctgagtgcccagccacaaacagggaccagcagtgggtgccacatgggtgctcagaagtggcccccacccacaccctcagcaccttccacccaactcagctcctggagtggcccaggaacccctttcccagactgatatattgatgcctccacaccctggaagaaatctggagctcccaaattctgggagcagagctctccttcatgctgcaggaacccaaaacttttttcttaggatgccacagtgagagggcagagaaaaatgaggattcctctcacccagagttaggacatctctctgtttcatgcccaggttcagagatattcaccagttacacaaaggccgtgcccaattaccctaacataagcagaaacacaccaactgacatagctgctcccgcccaccattcacaccccacgaccccaccagttactaatttcatctgcagtcagacaggtcctgaaaggaacactccagttccacacacactcccccagcagctgttcccacagcagtacccacagacacccagaagtcacgtagtgtgaccctcggatcttcgggccacgcgagtaccccgtcacacgcacacgcgcgtacacacacacacacacacacacacacacacacacaaagtgcccctgggagtgagacccaagccagatccaccaagacccgcaggggcccaataccccacccgccgcgcgcactgacacccggagagagggacgcacagcggctgtgggtgaagcttcacaaaacccagtcgatagacacacgcacgagttgtacacaaagccttggggcgcgcagatacgcacacgcaggtccacgctgttgtacccaaagttgcgcgcagaaagccccagcacgccggctgcccaccgcgcccgctcccgccggcccagtccacaccccctgctcctgcccttgcccacagacgcgggacccggaaggccgaaccggaccaggcggaggcccggggaggccgggtcccctggtcgcatgtccttcggcgggccgcgaggtcaggctcgccgtccttcgccgccactccccgcccccggccctcggcctcctgccgcccccagcggtcccctctccgcgtgcgtacctgtgccgggcctccctccccgcctcaccacgctggggcgaagggcgcccggccgccggcgggcgagggtgcgtcctctccggtgcccgtccgccttcctgcagccggcgtacgcctgcgggggtctcgcctgcgggggtctctctcctgcggcgcagcccggagggcgcgggcccggccgccaccgcctcgccctcccggtctcccgcccccttcccggcccggcccggagccactgccgaggcgcacgtacctactcgcgccgcgcggagctgtacggcggcggtggcggccgctggggaggcgggggggggatccggggacggagggacgggagaaggggcgggggccggggctcgccgagcgccgcggagggagctccgcccgcggccggcgagggcgcccggagagttagcaaggagagggacaggaaggcgggtgatgggctggggcgagggtgcgggggctccgatccaccgtcctcccctcccctccaggcagatctggatcgccggcgcctgggcttagggaactggggcttggagcccgcggtccacgggcgcaggggcggggcgggcgggggctgctgaagaagatccctccccaccaccggagagcccctattgcgccaagcgcaggtgcctccccactcctcacccccactctgccacttccccttccccccacccccaccccgcacgcagcccccaggtaggaccccgggtcctctccgaggtccttaggtcgggacggtctcctcgggcgcttgcggctccgtggctcaagggcgccacctgaaggctgcaagaaagaatccgacgatccccctcccccttttctctgcaatttttttctccgtgggacagtggagtgctccgcccaagaggggtgttctcctgggggcattgccaatggccaaacacaccctcaccctccaaggcccagctgtggggcctcttctcctggaacccctccctgggcacacacccacttaccccacgggcccctccatctgggctctccttttgcccgcactgtttgctcttgtctctgacggtcgtgattttgtttaagggtcagcctcctccatcggattggcagctcctggagagcaggacccatgtctgatcacctagaagacctaggtgggtgtgggtgaacaggctgtgaaaaggggtgactttcacttctttcctttacagggccggagttaagatgagtccagcgaagtgcctagagtaccaaattcatggagacgtttcctctttggggaacacacgccaaccccagagacagctttggtctgaatcgtgcaggttccgggaagacacggtgaccagctgaatcgtgtggtctcggttagtacctctggcctctgagcctgtatccacttctgtccatgaggattgtgaatgtgcaggctttgagggctctgggaaggccagcagaagttggccatgtggaaggacaggcgaatgagtgtgccatgtcctgctcctcggccacctcatgagcggagcctgacctgccctcctccaaagttctgtgcagccctccccaaccaggagactggaagtcaccctggatgatggatgcctgtgccttcaaggccagcatagcctagccctaggcaggtccaccagggctgggaaggcctccatttcctcccagccttgcagaggcctggcccgttgttagagacttcaaagggatgctagccctggcaccacactcctgttcaaatcccagctccacccccacagctgggtgccctggtgtaaaggactgccctcctggagctcggtttcctcctctgtgaaacggatgtaggaagtgttatgggaatgggatgagataccgcctttaaagcactcactgttccttccctcagtcatgcgctgtcctacctcagcctttgcgctggctgttccttctgcctgggacgtttttctttctgatatttcccgcactcacccccttccctcacttccttcaagtctttgctcaaatgccaccttctcagagacgccattccaggccatcctttcaaaaatagcagtgccccagcactctttactccctcactctgaatttttctctatagcacttaccaactgacattagtttctgtttgcttattgccacctcccctaaaaaataagtgccaaaagaagagggtttttgcctgtttccctccctgcagtatccccagacactagaaaaggggctaacacctaggaagctctggataagtgctcactgaataaagaacagagaaaatgggcaaatattatatactagttagctaggtagactccatccctacactcaggaagcttgtattctagtgggagaaaaggataagtaaatgtaacattgcagttatagtaaatgctaccaaataaaagtatagagtgcaagcctcaaacaagggtgccaacctagtcttggggataggaatggcttcctgtaaaagtgtggactgagctgagattagaaggatgagtagaaggcaaccagataaagaggggaggaaagagaagtccagcagagcgcctagcataggcgaagaccttggggtagaaggaagtgtgtgacgagtttgagagttgcaggagaccagtatggttgtcatggagggcctgataaggaacctggtaggagacgagcctgggcttagcaggtcaggtcactgcagagccttacaggccaagtaatttgttctttatcctcagagcagtggagagcctcactgatgaatgtaagtaaagggttaacaaaaccttttcctcttttgcatgagaatttgacctttggaagctctgtttcctggaaacagataaacatatgtctgctatgttactaagcaacattgcttctgataaaaatgacccctgaggaggaggctagaatgatccatgtggcaacagattagaattggagataccagaatgaactcatgtttagcttaatatagatgcagatgattacatacagaaagttatatatatatataatacacacacacacacacacacacacacacgggctagtatacacacatttatttccttactgtcaggcgagagggcctagaagcaatgatactccatagcaacaagcacacgtagcactgaaatcttggtttctaataccattctccaataaaaggatccaaggctccttgaagaaattgctgtttataggacttgggcaggaaacactacaagatgagcccagagcatctgatagtgccagaaagtaaagaaatgctacacacacacacacaccacacaccacacacacatgccacacacactctacacacactacacatacactacacacaccacacacactacacacacatgccacacacacactctacacacacactacacacaccacacacatacc

SEQ ID NO: 480 - DNA, 8000 bp, Homo sapiens
  Locus number 92 genomic DNA region, glycine receptor alpha-1 chain precursor, glycine receptor 48 kDa subunit, strychnine binding subunit
ttagatctggtttatctccctgcctttattcccttctcaagcacatgctaggtccatttttgttttatcagggtgctttatatatttcatgaggggcattttctcaaggaagctagactttcctcctcgttataattactacattggagcagctgattaaaaatttggtcattctgtactgtggtttgaaaccttggacaattttgtctcccctttgcccaggatgtatatttggcaaggtctggagacattttttgatggtcatgactcagggaggtagtgctactagcaccagggatgcggctaaacatcccacaatgcccaggacaacttccataacaaagaattatccagttaaaagtgtcaacagcgcagagctggagaaacatgtgtctgtttgagttgctcagaaggcaagagaattttggggtcatactgggcctgacccagccataagcctctgtaagggctctggggatcaaagccaagttcacttcggcttgagaggacatttgaaagaaacgtgcttctaccattaaaaaaatttgcctattatttttgaccagtctggctacagggccccattctcaaatgaaaataagggaaaacatttaggttattgactctcagaatgccacttactgaattttagaaccataggtttttaaaatatcaaatcaggaactttagccaaatcacccgatcttacttatgaagacacagttgatgagcatgcaatgctttttgtcttccaggaccccatgtttccctttctaagacccagttcctcctctgtgttggtaccatatgggatttccgcctcattcactcgatttttgtttttgtttgtttgttttgctgttgttattgccatttcgctggttatgtgctgatgcagcatgtctgttattgagagcctttcctagcccccgatttccccaacaaggtgagcagctggcatcatttattctaaggagtacctgggtgactgagatgattggattggccattccaacacagcacccatcccctggggaagaagggtttattcacatggaacctgctagagacctgccagcctccatctacccccaaatacattctaataagtcctcacattataatgcttctgtattttcacctggaattttaaaagtgagtgacttagaaatgaaaataccaattgaacaaatacaatctgctcactttgcttccttgtgacctttttttaatctctctgaaaaattgctgaatttcctgagttcaattattgtctgtattgtgtttcaaaaatcaacatttactcccctaatgaagtagccgttcctatattttgaaagtgcagtggtgccacccacatttccagctctccacagttataactcttctttccttataaacacgtagaattatatcccacatccattgtagctcatgtgtgcgttcacgcacgtaggggaaagagatgtagaatgatgttttctgttaggccaccaccagcttagttgaagaattaacacagtggattcataaccttatcaaaatgactacaatccagaccttttagactgagtctcccttttgtgaaagacaatgtctggagaggaaaatcaagcattgcatactgctcatcaagaaaaaaagagagagtgtgtgtggggagaaagatgtgcttggttctattaatttgctcttaaatctctctggttcagttctgtctcctgtagaccaagcagagaatcaatttgcatacaaatgttacaaagtacccaacctccatacatttgtagttctattaaatatgcaggggataaaggatctcatattataaatagaatacttcctgccctttcccccataaagtagccacattttgatacgtttcataaggccctggattgttgtactttttcattctatctgactctctgactatttgcagtctgatctgtggtcaggactctgtggcctacaaaataattgtttgaacaggagattagaagctttagcattgggtatctcagataaggggggatgccttttcttcatctcaagagacatgaaaagagactgaaatacagaaacttactatttgaggggaggtgtcatttaataaaccagccaacagattagtcaaatcagcaattcctatgaactgtaataaaacaaaaattatttgctgttttatgttgggagagggtaatatttggtgaccacttatttttaaaaacaatttggggtgggtttttcaaatgactgttaatccaatgccacagtaaaatatgagaggcaggcatctaaaatgaggaagattaatgatccctgcatgtcatggaagaagaataatgtttttcaattcatataagtggaatttatcatagccatctctgaagatggtatgattcacacacttactaaaggactatctatttcaatgcttcttaaagaggtgatttttcacttttcacttctactaacataagaaagacaagtcttcaggcagaaaattttaacctgagagacagtggatgggataactcagctgttgagtcaaatataagcataaatttaaaaacaaagcaaatgaagattgctcatgagttcaggatctgcagctaacagagtttggaaaggtgggttggggaaagaggcagtcaaagtttcaaaagggaaatgtttcccagtatgttcctaaatagatccactctgcacccaagttcagggctttacacactgaggttataatactattgtttccaagcactcagccttagtaatccccctccctcttcgcagaaaaagaaaacaacagcaaaaaaggacagaaaatgaaatgatctgtgtccagcgagtttgagtgcaaccttccccgtcaccgctagttgtcacttggctcccagacgggaaagctgaggttttcggcactgcggttagggagaatgcagtcctaattaaactgagtaactcctaaagcttccctttaaagtcctcagccgagtgaaagccaacatgcagtggggctggggaccaatagtggggggtgtagcagacagaaggacaaacaaaccgtaagaaacaggcaaacagctgccagaacagcgactgtctcagacctccacgcacaagccagacaccctgcgggcgggggtggggtgggtggcggggggtgggaggggggagaagggagacgggggatggaaggacccgattgcagtggaatacagcacccctcttccccaaaatgatgggaccacggacagaggtagcctccgtactctttccccccatttccatcagagcgatgtggtcagtagaaaattgcatacctgaagaatacaatggtctcccaaaggtagagtcgaagagtattgaagctgtacatttttcaggtccttgtgctttgtagtccacgagttatgggggcaaaaatgtttcaaattggcacttacaaaaccagaaagcgctattgcaaaaaataatccagatgttaaagggaggcggggaacaggggcgcggagggagagccccaggggaaattggagcgagggggtcgtagataccacggacagcggcggctgcgaggcgtttcagcaccacggagagcgtccagacctgcttttcaggagcgcgaagagtattgctgtttgttaaactccagcgtgtctgttggctccctgcggcgctggggaggcacgtttgggggtgggtatatttccttttttttttttttttttttaaacccctgtttttctgtttaaacggccagctccctgcaaggaaaaaaatcttctgtggagatcagagcgctggcctcggaccgttggattgggcgagcatcttgggtaaagagaacagagctttatggctctgggccggcctgagggggttaggggcgaggggaaagcggttgacggcgctgccttcagttaaatctcggagagtgtgccaggctggcgcatcgcaatccagtctcggaatctcgttctcctgcctctgtgcgggtctgctgtcgccttgctattcctgtttcccggtccccgccgaataagttgtgatcactgcagaaaaggtgtcccattgctcggggccgcaggcgtcagagagcccagggcaagtttcaggggctaccggggtccctggctaccccgcggggctctgaagcccaatgtctcagatgcatctcggttttctgagctcgctcatcttcccttggtcaagactccttcagatcttcagactttcttactgcattaatttaacaaactggaggcgtgggggatgggaggggtgatagccgatgggagggggttgagggggaaaaaaaaagggggaaaactccttagtatcttcaaaccctcccactcgaggtgttcattggcccgcggctacgaaaaccagatcttctcccggtattcggccaatagcctgttagactccgggttgaatttaacgcttagagtgctggacgagatctgcgcaatccccttcctacccccaagcttctttccgtgtaagcggtggggtgagagaggatatggaattaatctctctaggtctctcaaaaggttgccttgatttttaaagaatgcagttgtatgtgagtaaaacacatggttccttgttaagacgtgctctgggctcaatttatccttttaaaagggaagagttgaaccagatccctgattttttttaaaagagctctgaagttataatatttggccctagaaagaaaggaggaatatccaaaaagaagtctggtggataaagaccccctccagggtcaccgcagcagggaaatacgagagaaattctttgagcagtttccagcgttgagtgggaggtgttgtggctggcacccttttgagagggaataaaagcaccttcttccaactggacaggagacagttttattcgccttttatatgctggggaaactgagcctcacagagctgtggcttgctccaaattgatggcagagccaagttgtacacacagggatgtgttatgactcacatttcgttatttcttcctctgttttcccaccttatttgaatcttagaaaccagctatacatttcactgtaaagcccatctggtgagatggagttaatcagattttccccaagctgtgggactataggataaatactttaaaggattttctggctgatttgaactcattgggactctggggactctctcgcccaaggctactgagagaggacaacccctcctccttacccaataacgttagaaactcctttggctgatctcccaagaatactcatcagctcagctccctccaaggctaggccttctcccaagcagaaaggatctgaaaagtcttgtttactagcctcttaccagtaggatttcccctcccctccccctgtactacaatagcataccccacactaccggttctgttattggctcccacagtctagaatttccatgatattctgcatagtgactgaaaaggaaattttgttttgaaggtgtatattaatatgagttggatacaaatttaaatataatgtataatatatgtatttttatatatgtaatcaagagctaacctttattagcatggtttctatgtgtcagaaattactgtgaattcacataatctcatttacttttcacagtcaaaccttgaggtaagtattatctttgcgtatgtgtttgtgtacatttgtgagtatgctagggcaaaaccagcttgtaggttactgtgtatacaaatttatttatgatttgtatcgtgcctaattctgaagtgattttgatatgcatatgtgtatttgtacgtttgtatttgtaaatgggtctttctctacatacacatagatgtgtatgtatctatgtgtgtctttgtggtggtcctagaagtactgaaacaagccgtaagctggcaattttgtcctggttcctcatctgactaggaaatacctgcatagccaggtgtgatgcagtatgtggaaatttgtttttcttttccttcaaggggtgctgagtgtgtgttgctgttcatgagtgtgagtggctccaaggctgtggcctgtgcaggaggtaagagtaattattacctggggtggtggaggggcacctgtttgttaataggcctctgtttactatgaggctgatactttcatttaatcagtacacatgaaatgagcatgtgccaagtattggggatatgacagtatataagataaacaacacagtatatactgatagtgtataaaataaacagtatataagataaacttttggaacatgcagttgcttcagaagttcagtgggaagagtccctcatgttaatctacactttttaccctacatatcacatatttatgcctgtacagatctttttgttcttgtttaggtcactattgaaaataaacaactgtgggcttggccgtcagggatttatgtccttattttatctctgcttcaaaaaggttggttatgttggataaatgactaaactccaggcctaagtgaaatgagggtagtaatgccacttttctcactgcaagaaactgcatagaataaatatttaagtctaaccttattgtagcttaccatgctatgaaacaaaaatcttcaaggaatggaatggattggcttcagctaatggctcatttctattggtaacttttctgtgtagtctgactccagcgtagttctaatacttgactggtctcttatagatcctagtagccagatttgagccctactaagtatgaataaattttgacacacggtgagacttattttattactagaaaagattcattattttattcattcaacaaacatttattgagcatttactgtgtatctggtactattcttggcactggggatatagcagggaacaaaacaagccaagagccctattctaaaggtatgcatcttctattggaggaaaacaagacaaacaaggaaatatatgatgagttaggcagtcataagaactaaaaagaaaaaggcagggcagagagtggcatggaggtgctattttatgtaaggtgatcatatcagagaatggctcctgaaaaggcatttatgtaattgaaggaagtgaaggaatgagtcatgtgaaccttgggggcaggtatggaaagctttctaagcagtgggaaaagcaaatgtaaaagcccggagaggggagtatgtttggagtgtacaagaaacagcatggagaccagtgtgcctggacagagtgagtgcagggaacagtgatagaagatgagattagagaggaagttggggactagagcaggtactacctccaagaataaaatttctgggatggcaggagcaaaatgaaagcagggagactagttaggagctactgaaaaagtccatgtgagaaattctttaagatagtcttgttcaacatttcgagtacagaagaggaaaattatatacagagaggttaatagacttaccccttagactcatagcgcagctgggacaagaacacaagcaccctaattatagctaaagggtgtttcaactatttttttgtttgtttcaattaagataaaggaaatgcagaaagaaagtcaggaaaatctatgagggaagagagtttacccgtttttattactaatatatactgatatatatcacatatcagtatcagatactaagggctcagtaaatatttattgcaaggatgaatgagtgaataaacaaaagaacaaaaagattcaggcagaggacacaaatacaggggaaagagagtaaggaatgttgttaatcagctgagattatgttgtcctgagccagctaatgtaattaatataatgccaagcctctgtccataatggcattcacagaggagagtgctgtatgtttcaacactgctttgacaggcctgaaagatactttgcaaagacagatagatatttggaacaactgagcagcttgcctaattgtgctgtagtatgatgaataaaggcctgaaaatgggactgtggaagagtc

SEQ ID NO: 481 - DNA, 8000 bp, Homo sapiens
  Locus number 93 genomic DNA region, similar to 60S ribosomal protein L7
gcatgcataaaataaattaaatatctgaataacattaccagtaattggtgaaattgccttatgttttcacatccttacaacaaaaaaggcatcaacaaatgaccaggaaaacaaaaggataatccattataattttccttattaacatagtgataggacagacacaattatgggcaatttcagtgtctaaaaatcaagtatgatgaaaattatattgaagttaactaagaaaaaattactttagctattgctccaaaccaactgctagtcaggatgaaagaaaatagcccctacttagaaaaatcagccactgacttagaagttgacactgaatcttttaagtttctacaaactataaaccatagctggagtgttcattttgatttgcctgggtgattctccatgatatggtttcccttcagacaccactgctttattggtgaatcatttatgctgatttagagagatattctagtgtttttctttctaaacacataagtaccaccttcagcacagcctggtatttaaaaatatatgtgtgtacccacacacaagcacacacaggatcaaaccagcataatcattttttgggctgctaatttgtgtgttttgatggtgatgtgaatttaaagtatttgataaccataaaaaccatcatggcataggtactgaccaacggagaaggataccagctgtgacattagagcaaagtactaggaccccttttgtgcaagaccaggggatcacagtaactggggtgcaccaggaagctgctatttaccaaccaaaatgaaagtcttttaatcggttaacaatggtgcaaccataccagggtgtcacaactaaatgtcagtactatacacacacacacacagagagacagagagagagagtgagagacagagagagagagagagagagagagagagagagagagagaaaaccccaaggaaggtctggcctctcccttgacctctgttatcccggtggttttagtcagcatcttgccaaatggacaccccataacagtacactcctgtagggctctggcaggtgacatggcagtccaaaccaatggtcatttctacaaggacaccccttctctttcagccctgacacctggaaaaccagtcttattcacagaacatagtagttgggacccaagcacgggtaccaccacttagattttaaaagccaaagatgtgtgaagtttgaaacagacagaaatgctccaaatccacccaagggaatctaaagaagatgatctatctatctgtctgtctgtctgtctgtctatctatctatctatctatctatcgattgatcgagagatgtggcagggcctgtatctcaagagaaagagaatcctttaccccatcaaagtgaaatttataaagaacagatccaaacatgcctttccatttctcaaaattctttgatggccagcatcactgatcttttaatatggtagaaaagggacttcataatggagcctcaccttatttcttgctgccttaaccctacattcaagcaatagtgaaccatttgtagtattggaaaacatcatgttattctatacccagacttccatttcactgggtgggcaatccattgcaacccacatcataagtcctggaattgtttgctagaaatcatcctagttgccttcatccaagtatcctgagtaacacaaggcttggcacatagtagatcccaatagtttttgttgagtagataattcagtataaccaggcagttctgaagaataaaatatggcaggcacactgtcacagatctttgcctgggagagatgaagacatgttcaatgtattctaagatcacaggatcaaaaatgaacagaggttaaaaacaaaaagactgaccacttccaggagtggtgaagacgaggagtcattagaactctcataccctgctggcaggaatgtaaagtggcacaaccacatggaaaacaatttggcagcttcttaaaaagctaaacatatacttaccataccatccagccatcctagtcctaggtattcactcaagagaagagaaagtatatgtccacagagatttggtacacaaatgttcattgaagtcttatttgcaatagctaaaatatggaaacaatttagatgtttccagtaaaacaactggtgaatggataaacaaattgtggtacatccatacagttaaacacttctcagcaataaaaagcaatgaactattgatacatgctacaaaaaggatgaatttcaaagtaatgatgctacgtgaaggtaaccagacaaagaaagagtatgaactgtacgattccatttattcataattctagaaaatgcaaactaaggataaaaagcaagctagggcttcctgagaatggaagaggaaggggtaagaaggagatattataaaaggggcatgcgaaaacttttggaaatgatgagcatattcactattttgattatgatggttttgagggtgtataggtaagtgaagatgcagctaactctatactgtatgtgctatttgttgaatttcaattataccttgataaagatatataaaagtaaataataactgagcaaggcatatgctttacgagaaaacagtcattgtggtttggggaaatcacaatgagacactaagaaggtaatgggaacactttgactttggaagtgtaagttagagattaagggtggcatttcagaaaaggaaaaatataagaaaaatgtctaacagtcaagactgtccaatgataaaataaactggccttggaggtagtgagttcctagtccctggaagtatttaatttgatgaccattaaatagcccttgaaatggattctcgccctggttggccaattattttctatgagccctaagattcttttaacctctgatacttacttgttcaccaagaagacactggcagggaatatttgctggtagcaaactccctgtcaccgatgctcatgaaaacaaccattaggaattttcctcaagaataaaagaagtgaaaataattcaaaggcttgggacttcaaagaagtcgagttgaaaggaaatcagttcttcagatataggaattactagtgagtacaaagagaagagtgagcgatggagctttggggagagggcggccgggtggctgaagtctgggtgtgagaatatcagggaggggagtaggcactggggtttagaaaacccagggggtggctataaaacacagaactggagtcgtgagcagggattgggtggctcgggtcttgggatgcttcctcacagatgctgtcggacttgctgtggaaataacttcccaaataacaaaacatatccctgtgttcaaaaacttccagtagcctcctgttgcacttagaacaccattaaaatgatttaccagggctacagagatactgctaagtgaaaagagcaagatgccaataaatgggtaacaaaaatgcaacggttttaaaaacaaagataatgaaaattcttttaccacgaatgtgtattctatctgagcattttgcacaagggtatcagtctggattattagactgaattaaaacttctcctcaagcctggcccaggtccccaacaagccccactctggcatatggcactgctctgagggggagacagggataattgctggaagcagagggtgtccgaagaggagcagttgtgacccccaccagccacctggatgaagcaattaaacaattgactgagtgaatctaacaaatgccaaagggatgaaaattgatttgggtaaaagacaaatgaggtcaatttcctcatttctgaaaaccaaggtgagagttaaggacagacccttccccagattccacatttcttccttagtccataaaggagaggatatcgctcttgtcttgtgggaagaaagctgccaactctttttacccatgagtcctccccaagaaaagaaaggatgaatgtaattgctcagagaacaacactcaccggaacatggcttactaaagggcagggatagggtattgcagggttagggcccgccacttaccactttctctttgcatacctcccagacacccccctttctccctcttcagtgccctataggcctgtgggcctcacccctcgatggctatctcaaagtcagacctgacctgtaagtcaatagtctttggcagatgtacagaactgaaattcgaatggcgaggatggcaagaaaagctggcaacttctatgtacctgcagaacccaaattggcgtttgtcttcagaatcagaggtatcaatggcgtgagcccaaaggttcgaaagatgttgcagcttctttgccttcgtcgagtcttcaatggaaccttcgtgaagctcaacaaggcttcgattaacatgctgaggattgtagagccatatactgcatgggggtgccccaatctgaagtcagtaaatgaactaatctacaagcgtggttatggcaaaatcaataagaagcaaattgctttgacagataacgctttgattgctcgatctcttggtaaatacggcatcatctgcatggaggatctgattcatgagatctatactgttggaaaacacttcaaagaggcaaataacttcctgtggcccttcaaattgtcttctccacgagttggaatgaagaaaaagaccacccatcttgtagaaggtggagatgctggcaacagggaggacaagatcaacaggcttattagaaaaatgaaccaaggtgtctaccatgattatttttctaagctggttggttaataaacagtacctgctctcaaattgaaaaaaaaaatagtctttaacttggtgaagaaggtgatatggtttggctctgtgtcctcacccaaatctcatcttgtagttcccataattcccacgtgttgtgggagggacccagtgggggatgattgaatcatgggggcaggtctttcccatgctgttctcatgataatgtgataatgagtaggtctcacgagatctgatggtttaaaaaacaggagtttctctgcacaagctctctttttgcctgctgccatccatgtaagatgtgactcactcctccttgccttccaccatgattgtgaggcctacccagccacgtggaactgtaagtccaataaacctttcttttgtaaattgcccagtctcgggtatgtctttattagcagtatgaaaatagactaatacacaaggagtaggaggctaagatctgtttctactcataacacttctgacatcaaatgtgtgggtttttttccataccaacacccaatgatccaactcttcagacaaccaactgggtgtccaaggacccagttctaacaccaactacccagaatttgcatcagaccccacaggttaagggctcagtcccacaagactgctcccatttcagatgctaattgcaagttctaggtctcctgtacttctaatagaccagctataaataaggggttcccccaccagcacccccatgttcaatggtttgctatgatggctactggaacccaggaaaaaccatttatttactattactggtttattatgaaggatacaaatgtacaccagatgaagaggcacacagggtgaggtcagaagggtcctcagcatggagacatctgtccctgtaggagttagggtgtgccaccttcctggcacatggatgtgttcaactcagcagctctctgagcccatccagtttaggggatttcatggaagttccattacataagcatgaaagattaaatcactggccatttgggatcagctcaatctccagcccctctcccctccctgaaagttccaatcctctaatcacatgattgattcctctggtgatcagcccctatcctgaagctagctaggggcccaccaagagtcacggcatttgcataaactcaggtatggttcaaagtcttattaagagtaacaaaagatgctcctctcacccctctgactcagaaaattaaaatggttttagggcctctctgttaagaactaaggaagaagatcaaatatatattttttcttctatcacaatatcacagagggtctactcagcctcaggcctagccatgttcccagtcgaggtttgaaacccttctttgcaacttgaaaccctgctttggaagtgttaggggtggggaggtgctgctttgtgtggaagctcctttgtcagaatcctggaagggaagaaaagggactggtaggatttgtccgccatgaattcttagatagtaagaaaaattaaaaggatgatacaaaggaagtagcaaattagtctatgcattaaaattggccttagacactcttctgtcttctgatagcaacagcaacaccaccacatgccaccatgaggcacatactgttatcccctttccacatatgagtaagagaaaacagagttaaaacaactaaatatcctgacttgatcattccatgactgatcattctaggcatgttacaaagtctcacatgtaccctgcaaacatgtgaaatagtatgtacccatacaagaaaaaaagttcaaacaaaaattaattaaaatttctaaataaatgtctaattaaataagtaacacagtagagaacagtgggaccaggtaagttccagagagtgtttatcgttgttgctgtttttctttgtgtttttgttgttattgttgttgttgttttttgagacggagtctcgctctgtcgcccaggctgcctctgttgcccaggttggagtgcatggcacaatctcggctcacttcaagctccacctcccaggttgacaccattctcctgcctcagcctcccaagtagctgggactacaggcgcctgccaccacgcctggctaattttttgtatttttagtagagaacgcgttagccaggatggtctcgatctcctgacctcatgatccgcctgcctcggcctcccaaagtgctggaattacaggcgtgagccaccgcacccggcctgttgctgttgttttttaagacaaggtcttgatctgtcacccaggctggagtacagtggcaccaacatggctaactgcagccttgacctcccaggctcaagcaatcctcacacctcagcctcccaagtagctgagaccacaggcacgtgccaccatgcttggctaattttttaatttggtagagtcagggtcttaccacgttgcccagcctggtctcagactcctgggctcaagtgatcctcccaccttggcttcccaaagtgctgtaattataggtgtgagccaccatgcccagccccagaaagctcttacttactgcactattccacctctttgaatgcatgaagggatgttctaattattattattattatattattattatagttttgaaagagaaagacactaaactaaggaggcccagtggcttatctaagccaaaaatagtcagggaagtgcagagaaggcagtgtggtgtagtgggtagcacttgggacttggcccctgaggatcagggttcaaatctcagttataccatgagcttcatcccttcatctgggaaactgagcatcctgacaaggttcagacaagatcatacacatacgagcacttcatgcatgcaatattatgtctggaaagcacagactttgtatgtagtggtttctgttgtcacagctgaccaaccttgagttgacccagtggttctccacccagggtggttttgtcccccaggggaccccgggcaatgtcacaattgacatccagtgagtagaggccagggatgctgccaaatatcctacaatgcacaggacagctccctgtaacaaagaatcatccagcccaaaatgtcagtcggacccaggctgagaaacactggtttggaataaatccatggcatttataacaattcgggagtagagtagatgctcaataaatatttgttgaacatatgaataaataaataatcaagttctgcaacgttgcctacaacgtggttatgtgagagcaatgttagag

SEQ ID NO: 482 - DNA, 8000 bp, Homo sapiens
  Locus number 94 genomic DNA region, MGA protein fragment
ttcagtatgtattacgaccctgttttccaaacctcacattgttggacactgaatcagtatttgatattgagacttgcctaaaaaatgaggatctgtggtcttctatttatttattcaacaaatatgtgtccaccctatcccaggcattgtgatcagcactggaatagagtggagctaatggtctaatgcggaagacatattaatacgtggttttaaaaataattaacacagttgtggtaaatgccataaagaaatacagggtactatgagagcatataactggaagaccttacctgatcatgagggttagggcaagcgtcttaaagaaaatacatttaaacttaagtatgaagggtgaatagagttaggctggaggcatctggggcaatcttcttaggcaagggtgaggaacgtggttatgtgggcttgagatgtggggcagcaaggaggaatggtgtttctttctctctctccctctcctctcttctctctctctctctctctctctctctctctctcacacccaggctggagtgcagtggcatgatcttgactcactgcaacctctgccccctgggcttaaacagtcctcccacctcaccctcctgagtggctgggaccgcagatgcacaccaccaggcccagctatttatttttatttttatttttattttatttttggtagagacagggtcttgccatgttgcccaggctgctctcaaactcctgagctcaaacagtccgtcccacctcagcctcccaaagttctgggattacaggcatgagccagtgggtgtttcttaatgaatgttgattatattccgtaacatttctgtccttcttttcatcctcccttctcttaacattttctaaaacatgcttttaatattactatgctgattaagaaactcttttctttctttaagagacagggttggggggtaggtctcactgttgcccagactggagtgcagtggcacaatcacagctcactgtagcctcgacctcctgtggtcaagcatttctctcacttcagcctcctgagtagctgggactgcaggcaccaccacacttggctaattttttaatattttgcagagatgggttctcactatgttgtccaggctggttttgaactcctgggttcatgcgatccacctgccttctgcctctgcctcccaaagtgctgggattacaggcgtgaaccactgcgcccagcccagaaagtcttaaaagttcctctttgggtacattattagctccttgaaggcagatatcttgccatttttaattccttaaatcgttaatttttaattccttaattccttcattacagatattggtggcaatcatactttgccccccagcatgacttgatttcagttgtagtactaaatggtgggcaaggatggagttgtctatgattctctttttaccctctgcctaggacctgaattttcaggttggctagtgaaggcccttttttttttttttttttttttttttttttttgagatggagtcttgctctgtcgttcaggctggagtgcggtggcgcgatctcggctcactgcaacctccacctcccttgttcaagcaattcccttgccttagcctcccgtgtggctgggattatgggcgcacgccaccatgcccggctaatttttttatatttttagtagagacggggtttcaccatgttggccagactggtcttgaacccctgaccttaggcaatctgcctgcctcggactcccaaagtgctaggattacaggactgagccaccgcacctggccgaaggactttttgtaaaaacaaaacaaaacaaaaaaaaaaacaagcatcttttgcaactcagtctgtatgtagcccttattttatgaatgttctttattatattgatattttaaacaaggccatagtccaggagtttgttcatggtagtggtttcatctgaagagtgaggtctttttgtcagttgacagaggatgttttagaaatcagaaccgaaaggattggatctgaatagattggatgaggaagtttgtcttggtggattctgttacttaagttgtgccaatctttggggttctgctgtagacatctgaaaagtgcatggggtgccagcctttcccctatcctcagcatatagtaggcactcagatatttgctgaataggaaaagtgtgcatgtaaatgagatagtgcctatgtgtttatagaacaatctaggatcaaaactgtgtacattctaggccagactgtttaattgcatgcattctctctagttttttgtttgtttccccttaatattcagaaaaatctacttgaacgtgcagtctaggaaaatcaaggcaaagacttttgtgttaggctggaccaataagttgagctatgataactgaaaaaggtggaacttaggagcatcactttagcagttagcttggcattcttaaaccttcggttatatatggatgccttttaaaggaggaaatttcttacattatccaaagtatacaaccaagaactttagtatgagaatgctgcattaaaagttgaatgtaaccatttaagtggttactcaaagcaaacaaaaaataaaaaagaaaaacaagcggttacttggtacctgcatgatggtaaatccaaactggatccctgaaatgtgtgtggtggtatgattatttttagaatatcatctaaaaacacttaaaagttctcataggaccctcagattcttgacatctcccgacctctctaggttaggcggactccactttgaaaaactatggatagttttcctctcccaccgagatctgtagtactgaatcttcaaagttcagcgttttttttttgttttgtttttttaaagtatctagtatttagttatatgtttgcctggtgtagggaaggagtaccaaaagagaatctccattccccttcttcccaagttgtcctcacagatcccccagttagagagatcatttgggttaacttgtctctttggggatgcatggttgttaaccagtcattcacaccttatgatcatatattttaatgctaaatcaacataaatttacttcttccccagaaaatggaaaatttttatgaggaaacctcagatccttgagaggaaggcattcttggtaaggtgggagattctgacagggcagcttgtaggaaagaagttcttgggttcagggaagaggaggaaggtgttaaactgttacttttcaattttgcctaggatcttgaatgctcttgctgaccgtgcctgacttggggtttcagaatgccttcagaagtctctaaagtagcctacacgttttctagttcagactattccagcagtttctgtcaatgttgttgtatatctcctcaggaagagcaaagtgtagagaaatatgaccttcctaagtaaaaagtaggtcagatcagtagtgttggataagcctccttctgttgactccttccttagtcttctcattctccttcatagtgttttgtattgtcacatagcatgtcacgtagtaggttctcagtgcttgctaattcttatcaaagaaggcagttttggatcattgaccacaaaatctgctctcctactccctacttcttttttgccttttaagaaactacgcttcctttttactggtgtcaggagcacagaagaaagaacagctggtaaggagtagagaaggagaaagaaaactactttttgaaggttaggagaaatactgtccattgatttacttcagcaactgcctgacacataatagatattcactaatactttctttgcacctcatagcttaaatgtcttgaagaaacaaaaattgaatgcacaggatcaaggcactaaagcttagataacacactcctgcatcgtttccctgttttatcaagatatctttcatctttatatccggcaatttagtggcaactcttcgctttccaactgcgcactgagtctttcggtctcctccccattttcctagtcgtcttcggttgtggatgttgtaaactcgaccatccgtctctcaaggtctttggcttcaaggtttcccaatgctctggagctgtccaagccccggtactccggggtggaagacctcagattcatttgacgggcttgtggaggttgggggtctgcggagccccgtgtgggtggggctgggcgcggccggggcggagccggcgaggagccctagggaaagggtgaaaggcacagttgagaaaggcccgccgggcattggtttcacagtttccacgaaggcttcgtgtgcaagcctgaggagtttaggtgcctccctcctgcctcgcctttcttggttctagaaccttcagtaggcttttctgggttgcagggacccggaaaagcagcggcttccactcggggggcgggtcccaagggtcttgctgctgctctggggccgtttggactcctggtgttgggggaggggtcagggaggtgctgctcgcgtctccttttgcgcctgcgcggcgggctccgagcgggtaggagcgcgtgcgcggtgacgtggacgtccggtgcgcgcgcgcaggctcttcagctggagcggacacacggtgtgcgaaccgaacagaataacccgcccccagcgggatgtgaaggactccgggtgaggccggccacgccccgcacggtaactctcgggcctgggtggagggcatcgcttagtactggcccgattggagtttttcgagagtttgaagctcttgtgtatttgaacggcgtgagaaacgttccgctgagagagcttcgcacgccctcgccaggccgggccttgcgcagggccgcctttggcgcgcccctgtggtccctgagcgaggctgcgcatgtcacctcgcgcgcgtccccggcctcacttccgcgtcgctcagctacctaactgggaacatcgacgccagagagagcggccacgaggcgggaggggtgagaagcgcccatggctcggccctgccctcgcgtgtgtggggtgccgctccgcgtggtacggtccgcgtgacgacttctcgcccggcgccgggctctaggtcgagagccacgcttacgcgcttttcagtttagagcctaggtctcgtggttctagaactccaagggaaacggtgtcggcgtcgcttttctgagaacttggcgcagcgttttgacacctgtgcaaacgtcttttctaacaagtaatttccggccaaattgtttgaggcaggacgtcaagtttaataaaggagggcgaggaagtgagctgtaggagtggggacttggtaaacaaaggaccggtggtgtgtaagtgcagaaatgagggaggggaaaacaggtgggaagagcaggtgttattttctttattcctctgtggggcagccttttacctagttctgtttatggggtttcccgtttctgttaaatggtcaagtaggtctctgccctcagtgcaaggtatctgggacattaacatcacccccccaccgcccccccaaagctccagtagccaaagttgagggatctatgtgtcagaagaatatggggaaactagggatcgtttcagactgggtcgggagtgcaaaagtggtagtgtcttgctgtacagatttttgccttgcctttcgaaccctgggaatgccttctttctctggccggggtggaagcaggaacgggtaaatgaggtctgaaaggaggggttactgatggcagaccaacacgagaaaccaaagtgcactcttttattgggaagataactttcccaaggttcgcctcgccggagcaaacacgtggatcatgagaagtctcgagcccacccgcgcgtgttgttgtagagcttgccaggcttatgcggctgagtccctggttaacaactgcttgctctgttcgttctttttgggcacgatgccgcggctaggctgcagggaaagtgcctgggggcggcgtgacggctgctgggaagggggttggcaggggagggtctggtggctggttctgtagtctccaaggtaacagaacgcggctgggtcccgcagagcgatcatcgggttccggccggcggcacgtgatctgtcgggactcttccccggaagagctttccttgcggcattttttcacgtggttcttggccagctgtcctttgcagttgaaaagcggcggtttgtgggtcattaatagtcgacggcgtctgctcctctcggggaaggcagtgagaccgagccttttactttcctgcgtatcggaacagcgctagtgtttcttgccgccaacggttgtttctagcgtttgtgtgggttaagtgggttgggtccactttacagaaaacacaggctaaagacttgaggaaattcagtgccctgggtaccttggcatacttacttcaagtttgactactgccagtttctgccttaaaagttcttcaaattctgcttacccaactgctagagacctgtcagctttctggccctgagttgtagttagggtccattcttaggaataaaaaatactcctgcggctagcagtaacaaatgatatctgggaagagaaggaggcagtactctcttacgcaggtgcaattctgtgccttaaaacctaaaagtgtttcagataatattttgacatttgccctataaggttgtgacgataaaatgcccaggatattgtctgttccgaagtgagtagttcttaataaatggcaagtaccatttattaaattagtaaaaataagcaaatgatggttaagagcgattaagaaagtattaatagttggctattttactgtctttgccaccatttgctttcattttattatatttatatccacattctgtttttaagaaacttaaaatttcttgacccagtgtttattggctaaatactgaaatctgagtgaacctgttctcttgaaatttgagtttcacaaatgtaatttaaccatattcttatagtgaaggatcatattaaggaatatactaacatcttggtgcctgccatactactgtatttattgtatgaaaggttgtagaagtttgtagcaatttggaaaacgttcagaatgtgttgcttagcatttgaatatttgtgtttttaaataatggtattgacttggaattttgattttgtgtaactaatttttggggttgagcacagtacattaatcattgaattaggaaactatctagtaaaactagtgtattttgtgagttgtatgaggatcattgctttagtagataaacatttcccaaagaggtcactggtgaaaagacattaaaatagggagtctgaaattgtaacaatttatggaacttgttagattacttacctaaaaaatgttttctatgatagcttttgtgtgtgtatatgtcttctggtgtgacatttcagagtgttactgaattttcccctccacaacttattttgttggctttttattgtagctattttatctagataaaaaaaaaatttgatgttgaaaagccgaattgaaagtttttgaatgttaaggtatatatataccaaaattgtggttttcattaaagcttttagtttcccagagtatttttaggatgttgctagaagatttatttcttcatgagtagcctacccttttcttttctttattattattattgttgttgttgttgttgttattattttgagaccgagtctcacactatctccaaggctagaatgcagtggtgctatctcggctcattgcaacctcctgcctcatcctcccgagtagctgggactacaggtgcgcaacacgacgcccggctaattttttgtattttttgtagagagagggttttgtcatgttggccaggctgatcttgaactcctgacatcaggtgattcgcccgcctcagcccctcaaagtgctgggattacaagcgcgagccaccgctcccggcctagcctacccctttctaaagtacatttgagttttgcggttggcttaagtagactttagagtggtcttggtgtgtctgaaacagctgaat

SEQ ID NO: 483 - DNA, 8000 bp, Homo sapiens
  Locus number 95 genomic DNA region, ferritin light chain fragment
tggagtttcggaggatgcccctctttctctttatccttcctccccacagtcccctcccatctcctcccttatacctcttttttttttttttttttttttttgagatggagtttcgctcttgttgcctgggctggagtacagtggcgccatctcggctcactgcaacctccatctcccaggttcaagcaattctcctgcctcagcctcctgagtagctgggattacaggcatgcgccaccacgcccagctaattttgtatttttagtagagacggggtttctccatgttggtcaggcttgtctcaaactcctgacctgaggtgatccacctgcctcggcctccgaaattgctgggattacaggtgtaagccaccacgcccagcccttatacctccttttaagcaatgtcctcaccccaaatccatctcagaaaattgtccctacccatatggtcagaagtccttcaagactcctggaaaagaaatcacaactacttttaaatcaaacgtctgactaattttggaacagtgagaacaggggctggttttagtcatctttggatcaggtgcccaatacaagtttgttgaatgaatgcctgactggtcaagacaaaatcagtctttcaaacagaagctagaaatcaaaggttgcctatagccccattcctctgtccatcctccccatctgttgagatggcacgatttcagaaaaacatccctcccactggtcaatcctttgaaagcttaattattcagagttctaaatgacccctttaagggttgatcatataatgctttgacccgttggactgtgccagtagaggaggagatgttctgtgttccccgagcctcttcatccaagaattccaaagtgactcctcctgccttgatccctcccaatggccctctcctcctcatagcccatggggacctcttgctggggcgtgacgctgcccacggaggggtggaattgcttcttctttttttttttttagatgaagtctctctgtcgcccaggctagagtgcagtggtgcaatcttggctcactgtaacctccgcctcctgggttcaagtgattctcctgcctcagcctcccgagtagttgggattacaggcacctgccactgcgcccagctaatttttgtatttttagaagagacagggtttcaccatcttggccaggctggtctcgaactcctgacctcaagatccacccgcctcggcctcccaaagtgctggaattacaggcatgagccaccggaattgcttcttaatgcagaatgtgtgtgcaagactgtgaaacagcaagagttggggagaaagcgtaggtttctgtgtgcatggtacctttaggactggctgtgtgtccacccacaagccagcgaaggaggtgggaacctgggattctgtttacccagccaccaacaagccccgttgcctttctggcacacacaagcccaatcacccagaactcctgaaaatataaatgttctcaagatctcatgtgggagctttttagctgagaccagccacacatgcaggagactggaagcactatttcccaggggtggaacaacctgctcagactcacttttagattggaggatacccatctcagcgtggattctcccaagaacagatcttaagacaagggcttggatgtaggtaatttacttgggaggtgattccaggaaataagagtgaagaaatggggaaagcaagctgtgaaagggagagaagccaacagtaaggtatgctgatgggccagttactgccatgggcaactgaggctcagtctggcttggcgtccactgagaaaccttgtagaacagccctcagcattgtctgcctggatgaccaggaggccagagtatttctccactgacttcagtgtcttggttgcttttcttttctttttttttttgagacggagtttcgctcttgttgcccaggcaggagtgcagtggcatgatctcagctcactgcaacctccgcctcccgggttcaagagattctcctgcctcagcctctcaggtagctgggattacaggcatgcgccaccatgcctggctaattttgtatttttttagtagagacggggtttctccatgttggtcaggctggtcttgaactcccgacctcacgtgatccacctgccttggcctcccaaagtgctgggattacaggcatgagccaccgcgcctggccctcttttcttttcttttctttttttgagacagagtctcactcttgtcacccaggctggagtgcagtggcgccatctagactcattgcaacctctgcctcctggttgttcaagtgattcttgtgcctcagcctcctgaatagttgggattacaggcgtgtgccaccatgcccagctaaattttgtattcttagtagagacagggttttgccatgttggccaggctggtctcaaaatcctggccttgagtgatctgcccagctcagcctcccagagggtactttcaagttacatctatggaacaaagcaagccgctctgctaagctcctccagttattgattacacaacccccacagctgtgaccaccatttggctaccaccatcatcacagcttctgcccctccaatttcccccagccaattatatcactgccttttctctctgctaggttctgttaggcctgagctttaaagagaaaggaataaagtggaatgatatatctttgcccataactcattctaggaaaaaggaactatgctggttttctttttcctccatttcaacctatccaatctacccaaatagttcccaatcattatcacctcatcccaaagcaacagacgggaaagaggaacagggcaagaaagcagacaggctttctggagtgacttttatccccacagagtcatagatgcagagttggaagagatgaattctctcatttgggagataaggacaccatgcagataaagagactctgtatcttctgcttttcctgctgctgcagtgcttcctccaggcaggcttccttagtttttcttggcttcctacccttccaacctacgccatcataatctggactccagccctttattccctcaaaggctgactcaggccatgactgagggaagaagcttggattctgtagtggaacagcattgtccatggggagacacggcttccatcccaggcctttggttccattacttagtttctcacttgcctgtctgtcatccaaaggggctcacaaggaggggaatgcagggaggagacatctccctaataccattggagtttttttccaggttaagatggtgcattgaatccacccatctacttttgctcctcccaaaactcactaaaactattataaagggattttgtttaaagacacaaactcatgaggacagagagaacagagtagacaatagtgggggaaaaataagttggaagatagaaaacagatgggtgagtggtaatcgactcagcagccccaagaaagctgaaacccagggaaagttaagagtagccctattttcatggcaaaatccaagggggggtggggaaagaaagaaaaacagaaaaaaaaatgggaattggcagtcctagatatctctggtactgggcaagccaaagaatcaggataactgggtgaaaggtgattgggaagcagttaaaatcttagttcccctcttccactctccgagcagcaggtttctctctctcatcaggcagagggctggagatttcacctccggagagagtaaaaaggaggatctctgggctggggcaccaggcgtggctgaggacaaaggtggcatgtggagaacaggggcgttaagtgactatttcctcactgcatgctgagaacctcagctttcttctctgatcacttcccaaatcactggcagctactctccacctctcttctctgagcactctgaccagccaaaagggaaagaatgaaggatactggcattcagatttccagtaaacgaccatccatgtctccctacggtgaatcacagttgacaagcccagttcctgcactcagggtttttcatagtcctttactcttaatcaagagcagagagctaaagattatgtcttaggttccctagaaacagaagctgtgatgcagattcagatgcatgcgatttattgcgggcgggccctcagaagaagctcctttttccacctccagaaagagcatggaaaggaactgagcaaggatgtggtcttggctggagtctagcctcagtctgacccacagggagccctggagcatgaattgcaccacagggttgatctcaccttgaagcaagagggccagcttttgtatccatatattgatcaatcactggctgtgggctgccagggaggaagccatgaattcccaggcaaggtagttcctacttgaggacaattctttagataaagtggcagctctggtctatttatgaccgagatttatagcagctgaaggtatgggcagaacaccaataacatctactgtagattaccagattaccaaatatctgaggaaagctgctaacatggaagatagaaaataaataacaataaaaacaagtcaaaacaagcaagcaaactaataattaaaataaacagaaaaaggcaagttggaggaaaccaagatttatttttaagaataagaggtgataggcagttcggcggtccagtgggtctgtctcttgcttcaacagtgtttggacggaacagatccggggacggtcttccagcctccgaccgccctccaatttcctctccacttgcaacctccgggaccatcttctcggctatctcctgcttctgggacctgccagcaccgtttttgtcgttagctccttcttggcgaccaaccatgagctcccagattcgtcaaaattattccaccgacgtggaggcagccgtcaacagcctggtcaatttgtacctgcaggcctcctacacctacctctctctgggcttctatttcgaccgcgatgatgcggctctggaaggcgtgagccacttcttccgcgaattgaccgaggagaagcgcgagggctacgagcgtctcctgaagatgcaaaaccagcgtggcggccgcgctctcttccaggacatcaagaagccagctgaagatgagtggggtaaaaccccagatgccatgaaagctgccatggccctggagaaaaagctgaaccaggcccttttggatcttcatgccctggattctgcccacatggacccccatctctgtgacttcctggagactcacttcctagatgaggaagtgaagctcatcaagaagatgggtgaccacctgacgaacctccacaggctgggaggcccagaggctgggctgggcgagtatctcttcgaaaggctcactctcaagcacgtctaagagccttatgagcccagcgacttctgaagggccccttgcaaagtaatagggcttctgcctaagcctctccctccagccaataggcagctttcttaactaccctaacaagccttggaccaaatggaaataaggctttctgatgcaaaaaaaaaaaaaaaaaaaaaaaaaaaaagaataagaggtgatattacacccatgaaacaagaataagatgctattttgagacaagaaacaaaaaataagctttaaaataaacacacacacatacacacacatacacacaacagcagaaatgaaaaattcaatggatggcttgagaaaaatgtctagaatatctcacagaaaatagatctgaaagacaaaacaatgaaaaacaggaaagaaaagatgaggaatgtagggggaatagtccaaaaggtttaacatctgaataacaagcatttcagaaaaggagggaaggaaatcatcaatgtgataattcaagaaaaatttcccaaattgaaaaacataaattgccaggtcaaaagggctcaccgtttgcctagtttaaccaaggcacataattgtgaaatttcacagccctaaggataaagagatgattccacaagcttgaacaaataaaagaataagtcatatactaagtcttaagaatcagcatggctccagacttctcttcactggaattgttccagcaacactggaaggtagaatactagagtaatatcttcaaaattctgaagaaaaattgtttccaatctagaattctatatacagtgaaacaatcaagaaatgagtggaatgaagacaatttcagatatgcacatcccatgtttccttttctgggaagtaatttaaggatgtgctccaccaaaccaagggagtaacccaaagaaaaagacacaacatgtgggaaatgggagatccaacacaggggagagggatgaggaatccctatgaggctgagatgatgaaacttggaggattggagcagagagactcaagagatagatatgttaaagactgtcatcaccaaagtgactactgtcatattgccatctttatagccactttttgttagaagcacagacttttgaggtaaattagataaaggacagagatcccacatactgttggaaagaggactggcctaatactgttgaggcttgggttctagtcctgacttactcttgaagtaggtataagatctgggtatgtcatttttcctccctggatctcaggattatcctctctacatgtcaaggataggctaagtgaattacatgtatttttaaggctattgtgccttagtgacatgtattcttcatggcactgtatacggttatatggcttttgaaaatgcagagtcatgtaactacctccacagtcatgctacagaacagttgcatcaccccccaaaaatctctcatagctcccctttgcagtcagcctcttgcctcccccttaaccctgtcaaccactgaccttttctccctccctatagtcttaccttttctagaacgttagataaatgcagtcatacagtatgaagcctttcagatctggtttctttcatttaacacagtgcatttagttttatgcactaaccagcaattaccactgatcttgttttcagttctctcccaaagcagatgctaagacaagaattcaagtgcaagtagtttatgtgggaggtgatctcaggaagcaccagttagcggagtgagacagggaagggaaagaagccaatacaggatatgtcagcaagcaagctaccactgtgggaaacaagctcaccctgctggagactctgggatccagtgcagagcacacatctcagctctatccagcccaaggagcgaaaaagctgggatttttatctaccaactccctgtccatcagtggttgagtgctacttcttagggccttcactctccagcacttctggcttgccctgtgcacagaccaagcatgttcctgtgactagaaataaaagcccccaggcagaaagcaacagatgttcacattaagcagctttccatgtgcaggggcgaatgccaagggtgatgtgtaagacactggcagcgtcagctgcttccaacccaacccaaatatttttattgttgtatgtgaagggaagcaaatatatactataaattcttaaattcattctgctggataaagagagaaaagtcctggatttcttctcaataggccaattttaaaggctacttttcatatataggatgggcaaagcacttttaaaaacatttatcttagattttcactgtatttatggtttacaagggtgctttgcatgtaaaacttaatgtttaaatagcacaagctcatacagtccatattcaatccctcgattattaatacaaaactcaattcaagcaaagacaaaggatataacagaagctaaatccaacttgtgaataatgagaataattgatttgtttaggttctattattcagaaagttatgtctttgtttttttttttttttttttttttccaggcagggtcttgccctgtagcccaagttggagagcagtggcacaattatggctcactgcagccttgacctccagggctcaaggat

SEQ ID NO: 484 - DNA, 8000 bp, Homo sapiens
  Locus number 96 genomic DNA region, Feature name ha1p_98491
tcccgggtgtaggtgtgtagctgggcctgcaggtgatgggcagaggagctggagagggcagggtcaccgcgcagtcgcctgggagccgtgggcagcacccagacccccagggtaggagttaggagctgaaacaagtaggccggggcaggccggggtgctctggtgtcccacagccagccttgccctcccatggtggggcattggggcccatcagttcagggtatccaggagagtctccttttcattaaggccagagggggcactcactgaaggacccaacaatgagcacggtcccccgcccaggctggctgcaggctgcagtgacaggcatgggggctggaggcccctggggcatggttctgcccaccccggtagcccaggccttgggcacaggcaggcggatgctggcagcagatgctaggaagacaacaatgtcttcagctgggctttttaattaacctcagccggcccctcctgaagggccccaattaagtgaagaatgcatggcagagtggggtcatgctccgggcgggttttaattaaagctccgtggcctgggcaggagcgcccccgcctgactgcctcctcccttgttcttgtgctgggcgaccacacacctccaatgggtgctacaggcctctcctcctcccgcctgtcaggccccagaccaggcagcccctctctgagccaccatcccgtcctggcatagtcccacccacctgctggttcaagcattggctgagcgtctgtggtgtgtccactgcaaaggcagacagaaatcacacaactagtaaccatgtcagatgtgcacatgccatgaagaaagcaggtgaggtgagggacagagagggctgggccaccatgcccaggaaaggaacctgcaggaggcaggcagggagtgcacctggagggtgggctctgtggacaggagcaggggcctggctgagcagctgaggggtcagcctgtggacgcccgcatgcaagaatgagagggaagacagacatgtctccggagaagatctataaacagcagcaagcacatggaaagacgctcaaagtcacgagtccttcaggacaggcaaatcaaaaccaccatgagacaccagctcaccccatcaggatggcagctattagagaaacaaacaaaaaaaagtcactggatgcagtggctctcgcctataatcccagctactcaggaggctgaggtgggaggatcgcttgaggccaggaatttgagatcagcctgggcaacatactgagacccagtcagtacaagaaaaaatatattaattagctggcatggtggtgcgtgcctaccatcccaggtactcaagaggctgaggtgggagaattgcttgagcccaggaggcggaggctgtaatgagccaaaatcacgccactgtactccagcctgggtgacagagcaagaccctgtctcttaaaaaatttaaattatttttaaaaggttaaaatggtaagtcctatgttatgggtattttaccacaatttttaaaatgagaaaaatttgaggacagagggctgtgggtatggggggctttcagccgcactcagcagaacaggggctgcgtggggcttctgagcagggacccacaccaggggcctggctccccacaagacccccagcctcacacaatggggtgtgccccaggaccgtgagccacgtattcacgggtcccaccagaagagcacatgcgtccaagaacagcagctgggcaggggtagcaggcaggcacgtgtgtcctgctttgttcagggcatctttgcattaatcgccactgcaggaccaacattctccacaactggcttcctttagagacacctggccttgggagcaatgaacgagggaagggagggtctcctccagggtcaccatgagcactctcctctgcccaagccacgccccctggccagccccgactctctctctcaaatctgagcgccaaggactccctccccaacgagccttgtgctgggggatccccttggttcttctggggattcgggatacagtgtgcccaggaagggagtagtctgatcctagcaaccagagtcaccgtggcaacaggtgacatcagagcccagcagccctgagccttacacgggacccaacctgctgcccaaactgacccatgggggagacacatgtccggctggacaggtcaggtggctgcctgcagaaaactcatgaccctgaggccgtgtgggcagacaccctatgcaggggtgcaaagaggatcatctgaggaaccccaatgcttttagccccaggtatttgactctcccggccttggcaccagacatgagggaaggaggtatactggcatcacagggtggccacagcaagttaccacaacctgggtggttcacaacagcaagggaggtatttcctcgcaactctgcagccagaagccccacattgaggtgtcccgggcatgctccctccaaaggttctggggaggaccctgcacagcctcctccagctcctggtggctcaggtgcctcaggcgcatggccacacactccagtctctggcctgtcttcatggctggttcccgatctgtgcatctcagatccccctcctctttctcttagacgatcacctgttacgggtccagggcccaccctaatccaggatggcctggtctcgacgtcactcattgaggatgtctgccaagaccctggttctacaggaggtcctgctccaaggctccagctggatgtgaaggggggtgcccaacctaccccactacaataccttcgaggtaaacccaggcactgacacctcagttgagaccttagagcagaaccaggttgccatggagcccagggtcctgcttcccaggaactgtgagagaccatctatgtggactgctgttttaaaccactaaggtttgctagaatttgtcaccaagcctcggaacacagacggggaccaacagttcccctctccccaaacaagacaggggccattcagaatccagtgcctttgttgtggactgctgtgtcctctgggtcctgtctgccctatgcggaacaagatccatttggttttttgttctttttttgttggagacagagtctcgctagagtgcagtgcaggctagagtgcagtggcatgatcagggctcactgcagcctcgaactcctggcctcaagtgatcctcctgcctcagcctcctgagtagctgggagtatatatacatcaagacactcagctaagtttttaatgttttgtagagacggggtctcactatgttgcccatgctggtctcaaattcctgagctcgtgatcctcctgtctcagcctctcaatgtgctgggattacaggctgagctaccatgcctggccactttgattttagtgtccttctctggggtagtgaaaagttgaccaccctataggagtccccagtatcattttgagacattactgctccgtgcagccccaagctgggaaggtcacacacagagtgagtctgtgatgcatcttggagacaaggcccccagcccaggcgtacctctcctgctagcctctgcctggaagcttggaaggtgaaaaggaagccctgaaagagaggtgcagaccccagccccctaaaacctggaggtgggtctcaagagaaaagcttcacccaggaggagcccggcaggcaccttcacaatgtgcctctccctttcccccatccgtgggggcctggcccttcctcactcccagccccgccacctcatagggacgtcacccaggcgttgccatggccccatgccctggtcagcctcctgctggtgtcctcatcacacctccatgtggaacctctctcgcacccacctccaggcctcatccagatgagacccctgccccttcacccacatggcccttcccaaacggggcacactcagtcattctctaaggacaaagggaagccccccaaccagctttcctcaccaacacatctctcccatctctgacttcctgccgcacaaggatcgccttaaacaagccttacttgatgccaacaacccccgacaagcagagccttttgtcaaaagtctgcttagcctcttgtatgcccacagcaatggtagctcactgccaagatgcttccacatttggagatgcaatctgttctgtgttggcccctgccactggcctggctgtgtcccctgccacagaccccgtctgtctcccagtccctggttgcccccagagagctctgactcaaaaaggccctagagcaaagtagctccacaccttcagccatgtctcttcaaagccgtggggcagcacccagtgcattcccagggctctgagctcagatacaggtctcgacggtggccaaggagatcccaggcaggccttgagctgtagggcaaagttggtcactttacagaatcccaggttctgacatccagcctggaagtagaccggaaagatccctctcccccaggatccccccgggggtctcaaggctcaagtagccatgatcatgccactgcactccagctggggtgacagaaagaaggaaggaaggaaggaaggagggaaggagggagggagggagggaaggaaggaaggagggggaggtactagggtggggagttggcaggtagacaacttgcccaagtcccacgggcagaagggagtgtccgaaagtaggcagaggcccacagtcagggccactgtctgagtccaggacaggcagaaggctcatgtgtgcaggcagggaccactctagctgacaagtggggtttcaccaatgcctacgataagtgatgcacgggactggggaaatggtgccatcagacactttaagacttgtggcatgtcactttggggatgccaggtattttgttatcctgataggaggagtggatcggtacatgtacccagagtcagaacttcttttgttattagcacctgaaatgataaaaccaggccgcctctgtcactccagttgatcgaggagtataaacaatatttccagccaggcgtggtggtacccccctgtactgccagcattttgggaggctgggttaggagggtcattttcccagttcaataccagcccaagcaacaaagcaataccttgtctttaaaaataaaaataaaaaagagagaaaatatttacagatttcatgcaacagctctgagatgaaaagttctgatatttcagcaacaaaaaccacaggtattgctaatactgcttttggggaatgctgcttgcatttaagatgggaggaaatgctaaatgtcactcagaggttaagaagagccaagatgtgcttttctgcaatccctccccagggtgctcacctcaccggctccccatttgtccacccaggcatgacaataggctggaaccagagagaaaacagtcctttccctgagaagccagcctgcctgggaaaacaaggtcccctgagagctagtccaggggagggacatgtgcagctctaggctttcatctgaggtttggagggctggcaggagatggggaaactgaggccggagtgaatataaggggaaacaggtgatgctttaaaaggaccagaaatcagacgactgtgagcaaactccctggagttcacggaactcaactgtaatttcctaagccactgtgtagtgcaggcaagccgctgggaccctcaccactggccaccggcttcccgaatgaccccagaccccagcccaggcccagaaggcagggcagggccaccctgagctgggaggtgggggcttctcccagggcccatgcagtcagcatagccgtaataattcctgtggcgtgctccaggtcctgtggtgtgaccagccagagggtaggctttgggtaggggtctggggaagaaggaaacagggccaggcagaggggacagcagggtcctatccccacctcaccccccagagaagtctttaagggtatgagttcttcctgccacaggtcttagaggttgagtgtttggactaagccctgagcgtgaggaggaagtactgactctggtggaggcagcgccaccctgcagaacaccctggcatcttgcagtgtgattctccagctttagcccacctagagtctcccaacagagagagcgggcagagcaaccatgttggagacagagtggggcaggatatccagagaggtgaactctgtcctgggatgcctggtgtagtagtgagctccccatcactggaggaatccaagataacattgcagtctgcagaggcaccaaagtgcttgttccccaagagggagggcagggctggggaaagagtaaaggtgttggcaataagcagacttgggcatggagtagtcaagctccagaggggttccatcctagctgtgtgacatcaggtacgtgtgagacctctctgaacatctgtggcctggctcaaatgccgcacacttcatagccctgcactcagaggttgaccaaagtgcctgccaggcctgaggtgggctggggtccccttcacctagccacaatggctgcctactaggtctcccacatgggtattcctgctcctttgccccagacagcccatctgtccttccagccaccttccctaggaggccagcccgttctgttgtttggcatccctgtctctgacctggttctcgggtgcagccacccccagaggagagaagcccagcccaacctgagctggcgtctttgagactgacaatggaggcggccacgaaggctggagggtccctgcccagcctggcccccaaacccctccctccagtcagctcatcccacccctcttggctaaacctcatctgatcccagggacctcagaggagagagaaagggatccctactccctaggcagcgttgggggagcacctgggcctcaattaccccaggaactcactgcctgacacttcttaactccctagtgggtctccttccaggggcagaaatctgggtgtgactacctgggctcccctgcgcctgtttggcctgaagacatcatctttgccccggtggtggtggggagcccaaaccaggagcacagaatcagcaggaagggactttttattattattattttcagacagggtctcactctgtcacccaggctggagtgcagtggcacagtcctactaggtcactgtaaccttgaacttctgggcccaagcgatcctcccacctcagcctcccaagtagctgggactacaggtgtgtgccaccacacctggctatctttgtaaaatttttgtagagattatgttgcccaggctggggaaggtacatttcttaaccctagggctggctatacaggaatccattttattactttttaaactgtgcatgtatctgacatacactctttcctgtctgcattttttcacattaaaaaatatatattttaaaggggccaggcacggtggctcacacttgtaatcccagcaccttgggaggccgaggcgggtggatcacctgaggtcaggagttcgagaccagccatggccaacatggtgaaaccctgtctccactaaaaatacaaaaattagctgggcataggggcaggcgcctgtaatcccagctacttgggaggctgaggcaggagaattgcttgaacccgggaggcggagattgcagtgagccaagattgtgtcactgcactccagtatgggcgacagagcaagactccatctcaaaaataaataaataaataaaaagtattttaaaggaaggggaggcaggctctggttcccacacaatccccgctcagtgaccctggagccacccctggccacgctctgccagcagagaaccaaagccaggtcccttcagccctaaagaggccataaccacatgtaacccccgtgaaatgtccgcacatggccccgctctggctgagcagggagaggcagcacaaccagaaggttccacaggcatccacaaccctccctggggctttccaagagtatctgagatgcctgtagggtgggagacgtccttcccctaaacag

SEQ ID NO: 485 - DNA, 8000 bp, Homo sapiens
  Locus number 97 genomic DNA region, zinc finger protein 560
tcacgccactgcactccaccctgggcgacaagagcaaaactccgtctcaaaacaaaacaaaacaaaaaattagccaggcatggtggcgaatgcctgtaatcccagctactcagtaggctgaggcaaaagaatcacttgaacccgggaggcagaggttgtggtgagccaaggtcacaccactgcactccagacagcaataagagtgaaactccgtctcaaaaaaaaacaaacaaacaaaacaaacaaacaaacaaacaaaaaacctgctggtagattctaggagctgagcacagcctctagcaacagccagcaacaagtcctataactgcaaggaaatgaattttgcctattgactgagtgtggaaatacattctgttataggcagaggttggagcaagccgaggttgcaccaccgcactctagccagagcaacagagcaagactctatcaccaaaaaaaaataaataaaaataaataataataaaattctactgtaggtttcagctaaggcaattaaacaagacacagcatgcttatcaaatttgtaaatggactatagaatttgatgactgatagaactggattcaaaattactgccacaggctggagtgatacactgaataaataggatatttatttttaaaaaagaaatagaatatacaacacaagaattaaacaacactcatataaaatgtctcacacataaaatataaaccaaaacactacacttctggccagccacagtagtagctcacggctgcaatcccagcactttgggaggccaaggtgggccaatcacttgatgccaggtgttcaagaccagcctggccaacatgatgataccgcatctctacaaaaaaataccaaaattagccaggcgtggtggtgcatgcctgtaatcccatctacttgggaggctgaggcatgagaatcacttgaacccaggaggcggagggtgcagtgtattcagatggcaccactgcactccagcctgggcaacagagcaagaatctgtctcaaaaagtcgggggcggggaaagaaagaaaagaaagaaagaacactatacttctgaaaatatatttgagtattcttattcaggatgaaactgaacaagacactgactttctttttgaaaacaagtggctttcagttaaaactaaaatctattttcagatgtagcaacagtaaaacaaacaaacagaaaaaacaaacaaaaaacaaactaaagtctgttccttatttctctccagaataatttttacactttacaatacatccattcagaaactgccaaatggtacaagacctatggatgggaatttataatatccagcaaaattaaatgtatatttgtcctctgacctaaagtccaatattaaaggtttaacctagtaatacacttataaaaatgttaactacatataaagaagttcatttactgcagcttactcatggatgctaaaataattagtaggaacgttgccggggaacaagatattctgggcgtcctgcaagggatggtggctcatgcttgtaatcccaacattttctgagattgaggtgggaggatcacttgagcccagtagttcaaggctgcagtgagctaggatcgtgacactgcactccaccctgggcgacaaaatgaatctcaaaaacaaaaaacaaaaaacaaaaaaaccccgcaaatatatatatatttttgtattttgtatttttagtagagacagggattcaccatcttggccaggttggtagagaactactgacctcgtgatccacctgcctcagcctcccaaagtgctgggattataggcgtgagacaccgcaccaggcctggctttggtctttttgactaaacctcttctgaaatgtgttcaataaaaagctgaacttggaaaaaaaaaaggtgggggtgggggggacagggaggaaggcaagaaaaacaaaagacaacaaagaagatcctggccaggtgcagtggctcacgcctgtaatctcagcattttgggaggctgaggcaggcggatcacgaggtcaggagatcaagaccatcctggccaacatggtgaaaccccatctccactacaaatacaaaaattagctgggcgaggtggcacgtgcctgaaatcccagctactcaaaaggctgaggcaggagaatcgcttgaaccagggaggcagaggttgcagtaagtcgagatcacaccactgcactccaccctggcgacagaacgagactgtgtctcaaaaaaaaaatagaatgaaatcctgtcattttcaacaacgtagatagaactggaggacagtacgttaagtgaaataaaccaggcacagaaacacaaagttgggcgtggtaagcggtggttgcagtgagccaatatcatgccaccgcactccagcctgggcaacaaggcaacatcctgcctcaaaaaaactctcaaaaaaaaaaaatcttgaatagagctcagatccaaaaacattccgttatattttagaagaatttggagaattttcatttattatacatagtaaatattagataacattattatttttaattttcttgatgcaaatagtattacggttttagtaaaacaacactcttatcattgagtcaggcattacccactacttaaatgtcgagcttaccatcctggctatcacggtgaaaccccatctctacaaaaatacaaaaaattatccgggcacggtggcacacccctgtaattacagccacttgggaagctgaggcaggagaatcgcttgaacccgggaggcagaggttgcagtgaggcgagatcgcgccactgcactccagcctgggcgacacagctagaccccctctcaaaaaaaaaaaaaaaaaaaaaatgtcgagcttcatctctgcaatgaatttcccattgactctcaaactgttcaccataaaatttatttacgagacggcgaatacacaaaacgctaaaaaacaggtgcagctacaatggatatttattcgtggtactggatggtcaacatacccataggtttaagttttttcgaaaaaaaatgcgggaaaaatacacttagtacagtcatcctgttaatggtaaattcgattattctagtattagtgtgtaaaccctccatcctttcttccaggaagcctggttatgaagctctttggagacgtacagagctaggaacttcagatgaaaagaatggctgagtattcttaggtttctttagtagaaagactcgcggtctacaaacgtttatatgcacatgcagaaatacgcacaccctagacaactaagaaagcacctttctaccggaacgtaatgtgtcaataaaaaatatacaggtttcacaaaggcaaaatgccaaaatctcacatgaaacactcgtttgcataaaaaaggaagcagctgcccccttaaaccaactttttcccaatgctcacccgaacacggtggagtcgccaggtccgtggggctacaggatcttggggacggagtcaatcgaacgcgaacggcaaaattcttttccctctgaaacacaattcacaaacgttgccttggagacttattttttaaggcctcagaacgcttggacacttttgaagacgggaacacacggctgaaaacagccctcggacgcgcccatactgcacttcccacccggctcctctaggggaccgaaggtcccaatggcctcttcgacgtggcctcacccgatggctccgcgactcctgcggactcctgtggagtggtccaggcctctgtaaggaggttcctcgattaccctgggtcgattgtgacctctgccaccccccgaaacaccgcccaacccactagtccacacgagcctcaccaaagtagtgaacgaccagacaacacaaaggaaaaagtggctctgaggaaacaggcgccagcgaccaaaagagagaactggcgcgccgcaacgtcacttccgtttggggcattggaaggggcgtggctcgttgtgtgggcagttggacaggatggaactcttcaggattctagtttccctccgcgtgggtgcggaggtatcaaggggtcggctcagtgcctgggtgggcaagagagaaatggacccacagagaaaggtgggggttaaatcagggctgtgggcggggcccatgcccgggggcggggctggaggtgggaccagacccagccggtggcttcggtggcagaatggaccaggaaggcgaaacgtcgggcgatggactcgcccctcaggatgctcattagaaactttccccacgttcctggacccctttcaggattctctccagttgataacctgccaatccacaaaatggcctgcttcctgcattcgatcacgtctttagaactttattttctcttatttctttttatttatctgaccttgctaaactctaatcattgattcctctgcgttttcagttatcgatactttctgtaaatattgcaatttttttcttttctttcttttttcttttcttttctttttttcttcgaggtagggtctggctcggttgccaaggctggaatgcagtggtaggaacacggctcactgcagtctccacctctccaggctcaagccatccttccacctcagcctcccgagtagctgggaccacgggcgcaccgcacccggctaatttttgtattattattattatcatcattattattattttgtagagacaggatctaaccatgttgcccaggctggtctggaactcctgggctcaagtgatctgcccgccctgcactcccgaagtgggattacaggcgtgagccatcatgcaccatgcctggccttattgtatttttttttcttcttcaacaatgtatttgttactatttctcaaatcttatcaaatgattcaaagcctcctgtactactttatgaaataacactgataccaggcattcttcacttattctgtgcagaaaaagaaaggactgttggacttgtggtagagatttagttgaatcttcgggttatattggtatctttataatactgagtcttcctatgtgtgaatatacaatatctctctatttaggtcttctttaaactctttcagtaatgttttgaaattttcagtttacaaatattttacctcttggggtaaagttattcccatgtaacttatttgtaaaagggatcacattctcagtttccttttctgattgttcattgctggtgtatagatacaaaactaattttcatctcttgatgttgtactgtgcaactttacggaatttattacaagctctgctagttttcttgtagattcttcaaaattctctatatatcaaatatcacctataaatatatttttatttgttctattctaattgagaaaccttttattttattttcttgtgtaattgctctggctagaatttcctgtagaggctgggcacggtggctcactcctgtaatcccaacattttgggaggccgaggtgggtggatcacctgaggtcaggagttcaagaccagcctgaccaacatggtgaaaccccgtctctactaaagatacaaaaaattagccaggcgtggtggttggcacctgtaatcccagctactcgggaggctgaggcaggagaatcacttgaacctgggaggcggaggttacggagtttgcagtgagtggagatggctccattgcactccagcctgggtgacaagagcaaaacttcatctcaaaaaaaaaaaaaaaaaaagaatttcctgtagaatgttgaataacaatagaaaaatcagacatctttctctccttcctggtcttagggagaattttcaggcattcactattgaatatcacgttagctgtgttttcgtaagtgcgttttgtcacgttgaataaactcccttctgtttctagttttcttaattttttttttgagacaatctcgctctgtcacccaggctggagtgcagtggcatgatcttggctcactgcaacctccacctcccgggttcaagcaattctctgcctcagcctcccaagtaggtgggcactcccaagtgcccaccacaacacctggctaatttttttgtatttttagtagagacggggtttcaccagcttggccaggctggtctccaactcctgacctcatgatccacctgccttggccacccaaagtgctgggattacaggtgtgagccaccacgcctggccagttttcttaatttttatcaaggaaaagtgttgggtttcatcaaatgcctttcctgcattagttgaggtgattctgtgggattttttgtcttttgtactaatgtgaagaattacattttttaaatttccttttgttgaaccaaccttgcattcctagataaatctcactagtcatggtgtatagtgcttttaatgtgctgttggatatgatttgctaatattttttaaggatttttgcatctatattcatgaaagatagtctctaatttctttctctttagctttttttttttttttttttttgagatggagtctcacactattgcccaggctggagtgcagtggcacaatcttggctcaatgcagtcttgaccaccacaggctcaagccatcctcccacctcagcctctcaagaagctaggaccacagacgcatcaccatgcctggctactttgtgtgtgtgtgtgtgtgtgtgtgtgtgtgtgtgtgtgtgtgtgtgtgtgtgtggagtgttgctcttgttgcccaggctggattgcagtggtgtgatctcggctcaccacaacctccgcctcccgggttcaagcgattctcctgcctcagcctctcaagtagctgggactacaggtgtgcatcaccacacctggctaatttttttctatttttagtagagacagggtttcaccatgttggccaggctggtctcaaactcctgacttcaggtgatccgcccatctcagcctccgaaagtgctgggattacaggcatgagccaccacacctggctaatttttgtatttttttttgtagagatgaggtttcgccatgttacccaggctggcctccaactcctaagctcaagcaatctgaccaccctgggcctcccaaagtgctaggattacaggcatgagccaccactcccagcaagagatattttttatctggcttcagtaacaatgtaatgaatggcctcatggatttagaaagtgttctctctggccaggcacagtgtctcatgcctgtaatgccagcactttgggagaccaaggcaggcggatcacttgaagtcaggactttgagacctgcctggccaacatggtgaaagccaggctctactaaaaatacaaaaaattggctgggcatggtggcatgcacctgtaatcccagctactggggaggctgaggcaggagaatcgcttgaactcgggaggcgcaggttgcagtgagctgaaatcatgccactgcactccagcctgggtgacagagcaagatctcatctcaaaaaagaaaaaaagaaaaaaaaaagtgttctctcatgttttgttttgtttcggtttggtttggtttggtttggtttgagacagagtctcgctctgttgccaggctggagtgtagtggcgcaatgtcggctcactgcaacttccacctcccaggttcaagcaattctcctgcttcagcctcccgagtagctgggactacaggtgcataccaccacgcccagctaatttttgtgtttttagtagagatggggtttcaccatgttggccaggatggtcttgatctctttaccttgtgattcacctggctcagcctcccaaagtgctgggattacaggcatgagccacaacacccggcctcctgttctacttttttggaggatattgagaaacactggtgttgattactctttaaatgtttagtacaattcatttgtgaattgacaattcattgttggaaagttttgaaatactgatttaatctcttttcttgttataggtctcttgagatttttcattactgtttaatccagttaat

What is claimed is:

1. A method for determining the methylation status of an individual human, the method comprising:
   obtaining a biological sample from the individual; and
   determining the methylation status of at least one cytosine within a DNA region in the sample from the individual where the DNA region is on chromosome 3 and at least 90% identical to SEQ ID NO: 302 or is within 1.5 kb 5' or 3' on the human genome from SEQ ID NO:302.

2. The method of claim 1, wherein the determining step comprises determining the methylation status of at least one cytosine in the DNA region corresponding to a nucleotide in a biomarker, wherein the biomarker is at least 90% identical to SEQ ID NO: 302.

3. The method of claim 2, wherein the determining step comprises determining the methylation status of SEQ ID NO:302.

4. The method of claim 1, wherein the sample is from blood serum, blood plasma, urine, sputum, or tissue biopsy.

5. The method of claim 1, wherein the methylation status of at least one cytosine is compared to the methylation status of a control locus.

6. The method of claim 5, wherein the control locus is an endogenous control.

7. The method of claim 5, wherein the control locus is an exogenous control.

8. The method of claim 1, wherein the determining step comprises determining the methylation status of at least one cytosine in at least two DNA regions.

9. The method of claim 1, wherein the determining step further comprises determining the methylation status of at least one cytosine within a DNA region in a sample from the individual where the DNA region is at least 90% identical to a sequence selected from the group consisting of SEQ ID NO: 436, 389, 390, 391, 392, 393, 394, 395, 396, 397, 398, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485.

10. The method of claim 1, wherein the determining step further comprises determining the methylation status of at least one cytosine in a DNA region corresponding to a nucleotide in a biomarker, wherein the biomarker is at least 90% identical to a sequence selected from the group consisting of SEQ ID NO: 292, 293, 294, 295, 296, 297, 298, 299, 300, 301, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, and 388.

11. The method of claim 1, wherein the determining comprises detecting methylation density of the DNA region.

12. A method for determining the presence or absence of, or information about, cancer in an individual, the method comprising:
   a) determining the methylation status of at least one cytosine within a DNA region in a sample from the individual where the DNA region is on chromosome 3 and at least 90% identical to SEQ ID NO: 399, wherein the determining step comprises at least one of: nucleic acid extraction, nucleic acid amplification, bisulfite conversion of DNA, or cleavage of DNA with a methylation-sensitive or methylation restriction enzyme;
   b) comparing the methylation status of the at least one cytosine to a threshold value for the at least one cytosine, wherein the threshold value distinguishes between individuals with and without cancer, or provides information about the cancer, wherein the comparison of the methylation status to the threshold value is predictive of the presence or absence of cancer or provides information about the cancer in the individual.

13. The method of claim 12, wherein the determining step comprises determining the methylation status of at least one cytosine in the DNA region corresponding to a nucleotide in a biomarker, wherein the biomarker is at least 90% identical to SEQ ID NO: 302.

14. The method of claim 13, wherein the determining step comprises determining the methylation status of the DNA region corresponding to the biomarker.

15. The method of claim 13, wherein the biomarker is SEQ ID NO:302.

16. The method of claim 12, wherein the determining step further comprises determining the methylation status of at least one cytosine in a DNA region corresponding to a nucleotide in a biomarker, wherein the biomarker is at least 90% identical to a sequence selected from the group consisting of SEQ ID NO: 292, 293, 294, 295, 296, 297, 298, 299, 300, 301, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, and 388.

17. The method of claim 12, wherein the sample is from blood serum, blood plasma, or a biopsy.

18. The method of claim 12, wherein the methylation status of the DNA region is compared to the methylation value of a control locus.

19. The method of claim 18, wherein the control locus is an endogenous control.

20. The method of claim 18, wherein the control locus is an exogenous control.

21. The method of claim 12, wherein the determining step comprises determining the methylation status of at least one cytosine from at least two DNA regions.

22. The method of claim 12, wherein the DNA region is SEQ ID NO:399.

23. The method of claim 12, wherein the determining step further comprises determining the methylation status of at least one cytosine within a DNA region in a sample from the individual where the DNA region is at least 90% identical to a sequence selected from the group consisting of SEQ ID NO: 436, 389, 390, 391, 392, 393, 394, 395, 396, 397, 398, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, and 485.

24. The method of claim 12, wherein step (b) comprises comparing the methylation status of the at least one cytosine to a threshold value for the at least one cytosine, wherein the threshold value distinguishes between individuals with and without cancer, wherein the comparison of the methylation status to the threshold value is predictive of the presence or absence of cancer in the individual.

25. The method of claim 24, wherein the determining comprises detecting methylation density of the DNA region.

26. The method of claim 24, wherein the determining comprises detecting methylation density of a genomic region corresponding to SEQ ID NO:302.

27. The method of claim 12, wherein the determining comprises detecting methylation density of the DNA region.

28. The method of claim 12, wherein the determining comprises detecting methylation density of a genomic region corresponding to SEQ ID NO:302.

29. The method of claim 12, wherein the information comprises prognosis, cancer classification, prediction of disease risk, or selection of treatment.

30. A method for determining the presence or absence of, or information about, cancer in an individual, the method comprising:
   a) determining the methylation status of at least one cytosine within a DNA region in a sample from the individual where the DNA region is on chromosome 3 and at least 90% identical to SEQ ID NO: 399;
   b) comparing the methylation status of the at least one cytosine to a threshold value for the at least one cytosine, wherein the threshold value distinguishes between individuals with and without cancer, or provides information about the cancer, wherein the comparison of the methylation status to the threshold value is predictive of the presence or absence of cancer or provides information about the cancer in the individual.

* * * * *

UNITED STATES PATENT AND TRADEMARK OFFICE
CERTIFICATE OF CORRECTION

| | | |
|---|---|---|
| PATENT NO. | : 7,960,112 B2 | Page 1 of 1 |
| APPLICATION NO. | : 12/024803 | |
| DATED | : June 14, 2011 | |
| INVENTOR(S) | : Muhammad A. Budiman et al. | |

It is certified that error appears in the above-identified patent and that said Letters Patent is hereby corrected as shown below:

Title Page

Please correct the Abstract Section (57) as indicated below:

The present invention provides DNA biomarker sequences that are differentially methylated in samples from normal individuals and individuals with cancer. The invention further provides methods of identifying differentially methylated DNA biomarker sequences and their use in the detection and diagnosis of cancer.

In column 94, line 1 of claim 16, please delete "claim 12" and insert --claim 13--.

Signed and Sealed this
Eighteenth Day of October, 2011

David J. Kappos
*Director of the United States Patent and Trademark Office*